(12) United States Patent
Khan

(10) Patent No.: US 8,062,891 B2
(45) Date of Patent: Nov. 22, 2011

(54) NONVIRAL VECTORS FOR DELIVERING POLYNUCLEOTIDES TO PLANTS

(75) Inventor: Shaharyar Khan, Charlottesville, VA (US)

(73) Assignee: Gencia Corporation, Charlottesville, VA (US)

( * ) Notice: Subject to any disclaimer, the term of this patent is extended or adjusted under 35 U.S.C. 154(b) by 864 days.

(21) Appl. No.: 11/930,892

(22) Filed: Oct. 31, 2007

(65) Prior Publication Data

US 2008/0222750 A1 Sep. 11, 2008

Related U.S. Application Data

(63) Continuation-in-part of application No. 10/972,963, filed on Oct. 25, 2004.

(60) Provisional application No. 60/568,436, filed on May 5, 2004, provisional application No. 60/513,983, filed on Oct. 24, 2003.

(51) Int. Cl.
C12N 15/00 (2006.01)
C12N 15/82 (2006.01)
C07K 14/435 (2006.01)

(52) U.S. Cl. ..... 435/468; 800/278; 500/350; 500/388.21

(58) Field of Classification Search ......................... None
See application file for complete search history.

(56) References Cited

U.S. PATENT DOCUMENTS

| | | | |
|---|---|---|---|
| 5,804,445 A | 9/1998 | Brasier | |
| 5,831,020 A | 11/1998 | Citovsky | |
| 6,017,734 A | 1/2000 | Summers | |
| 6,127,159 A | 10/2000 | Fuller | |
| 6,506,559 B1 | 1/2003 | Fire et al. | 435/6 |
| 6,531,647 B1 | 3/2003 | Baulcombe et al. | 800/278 |
| 6,759,574 B1 | 7/2004 | Ream, Jr. et al. | 800/301 |
| 6,835,810 B2 * | 12/2004 | Hwu | 530/324 |
| 6,903,077 B1 * | 6/2005 | Heintz | 514/44 R |
| 7,001,768 B2 | 2/2006 | Wolffe | |
| 2002/0086356 A1 | 7/2002 | Tuschl et al. | 435/69.1 |
| 2002/0132990 A1 | 9/2002 | Huston | |
| 2002/0155095 A1 | 10/2002 | Nagabhushan | |
| 2003/0104622 A1 | 6/2003 | Robbins et al. | 435/455 |
| 2003/0186233 A1 | 10/2003 | Chesnut et al. | |
| 2003/0237112 A1* | 12/2003 | Brown et al. | 800/306 |
| 2004/0072739 A1 | 4/2004 | Anderson et al. | |
| 2004/0091878 A1* | 5/2004 | Sera | 435/6 |
| 2004/0176282 A1 | 9/2004 | Dalby et al. | |
| 2005/0015830 A1* | 1/2005 | Dorokhov et al. | 800/278 |
| 2005/0042603 A1 | 2/2005 | Wang | |
| 2005/0147993 A1 | 7/2005 | Khan | |
| 2006/0211647 A1 | 9/2006 | Khan | |
| 2007/0196334 A1 | 8/2007 | Khan | |
| 2009/0123468 A1 | 5/2009 | Khan | |
| 2009/0208478 A1 | 8/2009 | Khan | |
| 2009/0227655 A1 | 9/2009 | Khan | |

FOREIGN PATENT DOCUMENTS

| | | |
|---|---|---|
| CA | 2272788 | * 12/2000 |
| DE | 198 56 052 | 6/2000 |
| KR | 20030012226 | 2/2003 |
| WO | WO 97/27742 | 8/1997 |
| WO | WO 98/46271 | 10/1998 |
| WO | WO 98/56938 | 12/1998 |
| WO | WO 9856938 | 12/1998 |
| WO | WO 00/12732 | * 3/2000 |
| WO | WO 00/19993 | 4/2000 |
| WO | WO 00/58488 | 10/2000 |
| WO | WO 01/75164 A2 | 10/2001 |
| WO | WO 03/025195 | 3/2003 |
| WO | WO 03/052067 | 6/2003 |
| WO | WO 03/076561 | 9/2003 |
| WO | WO 2004/061456 | 7/2004 |
| WO | WO 2005/056752 | 6/2005 |

OTHER PUBLICATIONS

Guo et al, Protein tolerance to random amino acid change, PNAS, 2004, vol. 101 (25), pp. 9205-9210.*
Lesk et al, Prediction of Protein Function from Protein Sequence and Structure, p. 27 and 28, downloaded Sep. 16, 2007.*
Sandig et al, abstract,. J Mol Med 73:B10 and Matsushima, Y. et al., JBiol Chem., 15;278(33):31149-58 (2003). Epub May 20, 2003.*
Fortunati et al, A multi-domain protein for b1 integrin-targeted DNA delivery, Gene Therapy (2000) 7, 1505-1515.
Krueger et al, Peripheral-type benzodiazepine receptors mediate translocation of cholesterol from outer to inner mitochondrial membranes in adrenocortical cells, J. Biol. Chem., vol. 265, Issue 25, 15015-15022, Sep. 1990.
Futaki et al, Arginine-rich Peptides, The Journal of Biological Chemistry vol. 276, No. 8, Issue of Feb. 23, pp. 5836-5840, 2001.
Noguchi et al, Protein transduction technology offers a novel therapeutic approach for diabetes, J Hepatobiliary Pancreat Surg (2006) 13:306-313.
Anziano and Butow, "Splicing-defective mutants of the yeast mitochondrial COXI gene can be corrected by transformation with a hybrid maturase gene", Proc. Natl. Acad. Sci. U.S.A., 88(13):5592-6 (1991).
Bhat and Epelboym, "Quantitative analysis of total mitochondrial DNA: competitive polymerase chain reaction versus real-time polymerase chain reaction", J. Biochem. Mol. Toxicol., 18(4):180-6 (2004).
Carrozzo, et al., "Maternally-inherited Leigh syndrome-related mutations bolster mitochondrial-mediated apoptosis", J. Neurochem., 90(2):490-501 (2004).
Cervin, et al., "Cosegregation of MIDD and MODY in a pedigree: functional and clinical consequences", Diabetes, 53(7):1894-9 (2004).
Chen, et al., "Determination of normal ranges of mitochondrial respiratory activities by mtDNA transfer from 54 Human subjects to mtDNA-less HeLa cells for identification of the pathogenicities of mutated mtDNAs", J. Biochem. (Tokyo), 135(2):237-43, 2004.

(Continued)

Primary Examiner — Maria Marvich
(74) Attorney, Agent, or Firm — Pabst Patent Group LLP

(57) ABSTRACT

Methods and compositions for delivering polynucleotides are provided. One embodiment provides a non-viral vector comprising a recombinant polynucleotide-binding protein comprising a protein transduction domain operably linked to a targeting signal. Methods for modifying the genome of non-nuclear organelles are also provided.

7 Claims, 1 Drawing Sheet

OTHER PUBLICATIONS

Claros and Vincens, "Computational method to predict mitochondrially imported proteins and their targeting sequences", *Eur. J. Biochem.*, 241(3):779-86 (1996).
D'Souza, et al., "DOAsome-mediated delivery of plasmid DNA toward mitochondria in living cells", *J.Control. Release*, 92(1-2):189-97 (2003).
Falkenberg, et al., "Mitochondrial transcription factors B1 and B2 activate transcription of human mtDNA", *Nat. Genet.*, 31(3):289-94 (2002).
Grosschedl, et al., "HMG domain proteins: architectural elements in the assembly of nucleoprotein structures", *Trends Genet.*, 10(3):94-100 (1994).
Guy, et al., "Rescue of a mitochondrial deficiency causing Leber Hereditary Optic Neuropathy", *Ann. Neurol.*, 52(5):534-42 (2002).
Ignatovich, et al., "Complexes of plasmid DNA with basic domain 47-57 of the HIV-1 Tat protein are transferred to mammalian cells by endocytosis mediated pathways", *J. Biol. Chem.*, 278(43):42625-36 (2003).
Khadake and Rao, "Condensation of DNA and chromatin by an SPKK-containing octapeptide repeat motif present in the C-terminus of histone H1", *Biochemistry*, 36(5):1041-51 (1997).
Levy, et al., "Cytoplasmic transfer in oocytes: biochemical aspects", *Hum. Reprod. Update*, 10(3):241-50 (2004).
Liu, et al., "Mitochondrial DNA mutation and depletion increase the susceptibility of human cells to apoptosis", *Ann. N.Y. Acad. Sci.*, 1011:133-45 (2004).
Lu and Hansen, "Revisiting the structure and functions of the linker histone C-terminal tail domain", *Biochem. Cell Biol.*, 81(3):173-6 (2003).
Luo and Saltzman, "Synthetic DNA delivery systems", *Nat. Biotechnol.*,18(1):33-7 (2000).
Neupert, "Protein import into mitochondria", *Annu. Rev. Biochem.*, 66:863-917 (1997).
Oca-Cossio, et al., "Limitations of allotopic expression of mitochondrial genes in mammalian cells", *Genetics*, 165(2):707-20 (2003).
Petros, et al., "mtDNA mutations increase tumorigenicity in prostate cancer", *Proc. Natl. Acad. Sci. U.S.A.*, 102(3):719-24 (2005).
Pineau, et al., "Targeting the NAD7 subunit to mitochondria restores a functional complex 1 and a wild type phenotype in the *Nicotiana sylvestris* CMS II mutant lacking nad7", *J. Biol. Chem.*, 280(28):25994-6001 (2005).
Prosite Documentation PD0C00305, "HMG boxes A and B and DNA-binding domains signature and profile", updated Dec. 2004.
Rantanen and Larsson, "Regulation of mitochondrial DNA copy number during spermatogenesis", *Hum. Reprod.*, 15 Suppl 2:86-91 (2000).
Ross and Murphy, "Cell-penetrating peptides are excluded from the mitochondrial matrix", *Biochem. Soc. Trans.*, 32(Pt 6):1072-4 (2004).
Rossignol, et al., "Mitochondrial threshold effects", *Biochem. J.*, 370(Pt 3):751-62 (2003).
Roubertoux, et al., "Mitochondrial DNA modifies cognition in interaction with the nuclear genome and age in mice", *Nat. Genet.*, 35(1):65-9 (2003).
Roucou, et al., "Bioenergetic and structural consequences of allotopic expression of subunit 8 of yeast mitochondrial ATP synthase. The hydrophobic character of residues 23 and 24 is essential for maximal activity and structural stability of the enzyme complex", *Eur. J. Biochem.*, 261(2):444-51 (1999).
Schaefer, et al., "The epidemiology of mitochondrial disorders—past, present and future", *Biochim. Biophys. Acta*, 1659(2-3):115-20 (2004).
Seibel, et al., "Transfection of mitochondria: strategy towards a gene therapy of mitochondrial DNA diseases", *Nucleic Acids Res.*, 23(1):10-7 (1995).
Smigrodzki and Khan, "Mitochondrial microheteroplasmy and a theory of aging and age-related disease", *Rejuvenation Res.*, 8(3):172-98 (2005).
Srivastava and Moraes, "Manipulating mitochondrial DNA heteroplasmy by a mitochondrially targeted restriction endonuclease", *Hum. Mol. Genet.*, 10(26):3093-9 (2001).

Stephens and Pepperkok, "The many ways to cross the plasma membrane", *Proc. Natl. Acad. Sci. U.S.A.*, 98(8):4295-8 (2001).
Subirana, "Analysis of the charge distribution in the C-terminal region of histone H1 as related to its interaction with DNA", *Biopolymers*, 29(10-11):1351-7 (1990).
Suzuki, et al., "An NMR study on the DNA-binding SPKK motif and a model for its interaction with DNA", *Protein Eng.*, 6(6):565-74 (1993).
Suzuki, et al., "Maternal inheritance of diabetes is associated with inactive ALDH2 genotype in diabetics with renal failure in Japanese", *Diabetes Res. Clin. Pract.*, 60(2)143-5 (2003).
Tanaka, et al., "Gene therapy for mitochondrial disease by delivering restriction endonuclease SmaI into mitochondria", *J. Biomed. Sci.*, 9(6 Pt 1):534-41 (2002).
Taylor, et al., "Mitochondrial DNA mutations in human colonic crypt stem cells", *J. Clin. Invest.*, 112(9):1351-60 (2003).
Wang, et al., "Acquisition of double-stranded DNA-binding ability in a hybrid protein between *Escherichia coli* CspA and the cold shock domain of human YB-1", *Mol. Microbiol.*, 38(3):526-34 (2000).
Vestweber and Schatz, "DNA-protein conjugates can enter mitochondria via the protein import pathway", *Nature*, 338(6211):170-2 (1989).
Weir, et al., "Structure of the HMG box motif in the B-domain of HMG1", *EMBO J.*, 12(4):1311-9 (1993).
Zullo, et al., "Stable transformation of CHO Cells and human NARP cybrids confers oligomycin resistance (oli(r)) following transfer of a mitochondrial DNA-encoded oli(r) ATPase6 gene to the nuclear genome: a model system for mtDNA gene therapy", *Rejuvenation Res.*, 8(1):18-28 (2005).
Chinnery, et al., "Peptide nucleic acid delivery to human mitochondria", *Gene Ther.*, 6(12):1919-28 (1999).
Flierl, et al., "Targeted delivery of DNA to the mitochondrial compartment via import sequence conjugated peptide nucleic acid", *Mol. Ther.*, 7(4):550-7 (2003).
Muratovska, et al., "Targeting peptide nucleic acid (PNA) oligomers to mitochondria within cells by conjugation to lipophilic cations: implications for mitochondrial DNA replication, expression and disease", *Nucleic Acids Res.*, 29(9):1852-63 (2001).
Ross, et al., "Cell-penetrating peptides do not cross mitochondrial membranes even when conjugated to a lipophilic cation: evidence against direct passage through phospholipid bilayers", *Biochem. J.*, 383(Pt. 3):457-68 (2004).
Smith, et al., "Delivery of bioctive molecules to mitochondria in vivo", *Proc. Natl. Acad. Sci. U.S.A.*, 100(9):5407-12 (2003).
U.S. Appl. No. 10/561,829, filed Dec. 21, 2005, Khan.
Alam, et al., "Human mitochondrial DNA is packaged with TFAM", *Nucleic Acids Res.*, 31(6):1640-5 (2003).
Cline and Henry "Import and routing of nucleus encoded chloroplast proteins", *Annu. Rev. Cell Dev. Biol.*, 12:1-26 (1996).
Derossi, et al., "The third helix of the Antennapedia homeodomain translocates through biological membranes", *J. Biol. Chem.*, 269(14):10444-50 (1994).
Emanuelsson, et al., "Predicting subcellular localization of proteins based on their N-terminal amino acid sequence", *J. Mol. Biol.*, 300(4):1005-16 (2000).
Frankel and Pabo, "Cellular uptake of the tat protein from human immunodeficiency virus", *Cell*, 55(6):1189-93 (1988).
Ho, et al., "Synthetic protein transduction domains: enhanced transduction potential in vitro and in vivo", *Cancer Res.*, 61(2):474-7 (2001).
Kabouridis, "Biological applications of protein transduction technology", *Trends Biotechnol.*, 21(11):498-503 (2003).
Murphy, "Selective targeting of bioactive compounds to mitochondria", *Trends Biotechnol.*, 15(8):326-30 (1997).
Sandman, et al., "Diversity of prokaryotic chromosomal proteins and the origin of the nucleosome", *Cell. Mol. Life Sci.*, 54(12):1350-64 (1998).
Weissig, "Mitochondrial pharmaceutics", *Mitochondrion*, 3(4):229-44 (2004).
Wender, et al., "The design, synthesis, and evaluation of molecules that enable or enhance cellular uptake: peptoid molecular transporters", *Proc. Natl. Acad. Sci. U.S.A.*, 97(24):13003-8 (2000).

Gaizo et al., (2003) "A Novel TAT-Mitochondrial Signal Sequence Fusion Protein Is Processed, Stays in Mitochondria, and Crosses the Placenta" *Molecular Therapy* vol. 7, No. 6, pp. 720-730.

Gaizo et al., (2003) "Targeting proteins to mitochondria using TAT", *Molecular Genetics and Metabolism 80* pp. 170-180.

Suarez, et al., "Alterations in mitochondrial function and cytosolic calcium induced by hyperglycemia are restored by mitochondrial transcription factor A in cardiomyoctes", *Am. J. Physiol. Cell Physiol.*, 295:C1561-1568 (2008).

Blanchi, "Prokaryotic HU and eukaryotic HMG1: a kinked relationship", Molecular Microbiology, 14(1):1-5 1994.

Chang, et al., "Cellular internalization of fluorescent proteins via arginine-rich intracellular delivery peptide in plant cells", Plant Cell Physiol., 46(3):482-488 (2005).

Dietz and Schooner, "Advances in Phytoremediation", Enviro. Health Petspectives, 109(Supp 1):163-18 (2001).

Genbank, Accession No. NM 003201, "*Homo sapiens* transcription factor A, mitochondrial (TFAM), nuclear gene encoding mitochondrial protein, mRNA", 4 pages, First available Mar. 24, 1999, accessed Sep. 8, 2009.

Genbank, Accession No. NM 005035, "*Homo sapiens* polymerase (RNA) mitochondrial (DNA directed) pseudogene 1 (POLRMTP1) on chromosome 17", 5 pages, First available May 14, 1999, accessed Sep. 8, 2009.

Glover and Lindsay, "Targeting proteins to mitochondria: a current overview", Biochem. J., 284:609-20 (1992).

Laudet, et al., "Ancestry and diversity of the HMG box superfamily", Nuc. Acids Res., 21(10):2493-2501 (1993).

Lebedeva and Stein, "Antisense Oligonucleotides: Promise and Reality", Annu. Rev. Pharmacol. Toxicol., 41:403-19 (2001).

Mahata, "Functional delivery of a cytosolic tRNA into mutant mitochondria of human cells", Science, 314:471-74 (2006).

Rizzuto, et al., "Chimeric green fluorescent protein as a tool for visualizing subcellular organelles in living cells", Current Biology, 5(6):635-642 (1995).

Roberts, "Fast-track applications: The potential for direct delivery of proteins and nucleic acids to plant cells for thr discovery of gene function", Plant Methods, 1:12 (2005).

Xin, et al., "DNA binding by single HMG box model proteins", Nucleic Acids Res., 28(20) 4044-50 (2000).

Brydges, et al., "Mutation of an unusual mitochondrial targeting sequences of SODB2 produces multiple targeting fates in *Toxoplasma gondii*", J. Cell Science, 116(22):4675-85 (2003).

Bayona-Bafaluy, "Rapid directional shift of mitochondrial DNA heteroplasmy in animal tissues by a mitochondrially targeted restriction endonuclease,"*Proc. Natl. Acad. Sci. U S A*. 102(40):14392-7(2005).

D'Souza "Gene therapy of the other genome: the challenges of treating mitochondrial DNA defects" *Pharm Res.* 24(2):228-38(2007).

Del Gaizo, "A novel TAT-mitochondrial signal sequence fusion protein is processed, stays in mitochondria, and crosses the placenta,"*Mol. Ther*. 7(6):720-30(2003).

Flierl, "Targeted delivery of DNA to the mitochondrial compartment via import sequence-conjugated peptide nucleic acid," *Mol. Ther.*, 7(4):550-7(2003).

Khan, "Development of mitochondrial gene replacement therapy," *J. Bioenergetics and Biomembranes* 36L387-393(2004).

Maliga, "Plant Biotechnology 2007: all three genomes make contributions to progress" *Current Opinion in Biotech*. 18:97-99(2007).

Murphy, "Selective Targeting of Bioactive Compounds to Mitochondria," *Trends in Biotech*. 15(8):326-30(1997).

Seibel, "Transfection of mitochondria: strategy towards a gene therapy of mitochondrial DNA diseases," *Nucleic Acids Res*. 23(1):10-17(1995).

Shore, "Import and insertion of proteins into the mitochondrial outer membrane" *Eur. J. Biochem*. 227:9-18(1995).

Sloots, "Recombinant derivatives of the human high-mobility group protein HMGB2 mediate efficient nonviral gene delivery" *FEBS* 272:4221-4236(2005).

Srivastava, "Manipulating mitochondrial DNA heteroplasmy by a mitochondrially targeted restriction endonuclease," *Hum. Mol. Genet*.10(26):3093-9(2001).

Tanaka, "Gene therapy for mitochondrial disease by delivering restriction endonuclease SmaI into mitochondria," *J. Biomed. Sci*. 9(6 Pt 1):534-41(2002).

Vestweber, "DNA-protein conjugates can enter mitochondria via the protein import pathway," *Nature* 338(6211):170-2(1989).

Kanki, et al., "Architectural role of mitochondrial transcription factor A in maintenance of human mitochondrial DNA," *Mol. Cell. Biol.*, 24(22): 9823-9834 (2004).

McCullouch and Shadel, "Human mitochondrial transcription factor B1 interacts with the C-terminal activation region of h-mtTFA and stimulates transcription independently of its RNA methyltransferase activity," *Mol. Cell. Biol.*, 23(16): 5816-5824 (2003).

Scarpulla, "Transcriptional paradigms in mammalian mitochondrial biogenesis and function," *Physiol. Rev.*, 88: 611-638 (2008).

Opalanska, et al., "Nucleic-acid therapeutics: basic principles and recent applications", *Nat. Rev. Drug. Dis.*, 1:503-514 (2002).

Russell, "Replicating vectors for gene therapy of cancer: risks, limitations and prospects", *Eur. J. Cancer*, 30A(8):1165-1171 (1994).

Sandig, et al., Direct gene transfer of HMG1 based DNA-protein complexes, *J. Mol. Med.*, 73:B10 (1995) (Abstract).

Schrank, "Functional expression of the yeast Mn-superoxide dismutase gene in *Escherichia coli* requires deletion of the signal peptide sequence", *Gene*, 73(1):121-30 (1988).

Bustin, et al., "Recombinant human chromosomal proteins HMG-14 and HMG-17", *Nucleic Acids Res.*, 19(11):3115-21 (1991).

Dement, et al., "Dynamic mitochondrial localization of nuclear transcription factor HMGA1", *Exp Cell Res*. 307(2):388-401 (2005).

Fischer, et al., "Cellular delivery of impermeable effector molecules in the form of conjugates with peptides capable of mediating membrane translocation", *Bioconjug. Chem.*, 12(6):825-41 (2001).

Fisher, et al., "Promoter selection in human mitochondria involves binding of a transcription factor to orientation-independent upstream regulatory elements", *Cell*, 50(2):247-58 (1987).

Fortunati, et al., "A multi-domain protein for beta1 integrin-targeted DNA delivery", *Gene Ther.*, 7(17):1505-15 (2000).

Futaki, et al., "Arginine-rich peptides. An abundant source of membrane-permeable peptides having potential as carriers for intracellular protein delivery", *J. Biol Chem.*, 276(8):5836-40 (2001).

GenBank, "Accession No. AF151833" (PRI May 18, 2000, direct submission May 17, 1999).

GenBank, "Accession No. AK026835" (PRI Sep. 12, 2006, direct submission Aug. 29, 2000).

GenBank, "Accession No. NM_003201" (PRI Sep. 3, 2009).

GenBank, "Accession No. NM_005035" (PRI Mar. 29, 2009).

Kreuger, et al., "Peripheral-type benzodiazepine receptors mediate translocation of cholesterol from outer to inner mitochondrial membranes in adrenocortical cells", *J Biol Chem.*, 265(25):15015-22 (1990).

Matsushima, et al., "Functional domains of chicken mitochondrial transcription factor A for the maintenance of mitochondrial DNA copy number in lymphoma cell line DT40", J. Biol. Chem., 278(33):31149-58 (2003).

Mistry, et al., "Recombinant HMG1 protein produced in *Pichia pastoris*: a nonviral gene delivery agent", *Biotechniques*, 22(4):718-29 (1997).

Noguchi, et al., "Protein transduction technology offers a novel therapeutic approach for diabetes", *J Hepatobiliary Pancreat Surg.*, 13(4):306-13 (2006).

Porkka, et al., "A fragment of the HMGN2 protein homes to the nuclei of tumor cells and tumor endothelial cells in vivo", *Proc. Natl. Acad. Sci. USA*, 99(11):7444-9 (2002).

Tiranti, et al., "Identification of the gene encoding the human mitochondrial RNA polymerase (h-mtRPOL) by cyberscreening of the Expressed Sequence Tags database", *Hum. Mol. Genet.*, 6(4):615-25 (1997).

Uherek & Wels, "DNA-carrier proteins for targeted gene delivery", *Adv. Drug Deliv. Rev.* 44(2-3):153-66 (2000).

Wagner, et al., "Targeting of polyplexes: toward synthetic virus vector systems", *Adv Gen*, 53:333-354 (2005).

Zaitsev, et al., "H1 and HMG17 extracted from calf thymus nuclei are efficient DNA carriers in gene transfer", *Gene Ther*. 4(6):586-92 (1997).

Jacobs, et al., "Making mitochondrial mutants", *Trends in Genetics*, 17(11):653-660 (2001).

* cited by examiner

NONVIRAL VECTORS FOR DELIVERING POLYNUCLEOTIDES TO PLANTS

CROSS-REFERENCE TO RELATED APPLICATIONS

This application is a continuation-in-part application of U.S. patent application Ser. No. 10/972,963 filed on Oct. 25, 2004, which claims priority to U.S. Provisional Application No. 60/568,436 filed on May 5, 2004, and U.S. Provisional Application No. 60/513,983 filed on Oct. 24, 2003, and where permissible each of which is incorporated by reference in their entirety.

STATEMENT REGARDING FEDERALLY SPONSORED RESEARCH OR DEVELOPMENT

Aspects of the following disclosure were supported in part by NIH-NIA SBIR grant number AG022780. Therefore, the United States has certain rights in the disclosure.

REFERENCE TO SEQUENCE LISTING

The Sequence Listing submitted Jun. 14, 2011, as a text file named "GNC 0003CIP2_May232011_ST25.txt," created on May 23, 2011, and having a size of 720,626 bytes is hereby incorporated by reference.

FIELD OF THE INVENTION

The present disclosure is generally directed to compositions and methods for the delivery of polynucleotides and polypeptides, more particularly to compositions and methods for transfection, for example transfection of plants and organelles in plants.

BACKGROUND OF THE INVENTION

Plant cells have three gene-containing compartments: the nucleus, mitochondria and plastids. There are several types of plastid including: (1) chlorophyll-containing chloroplasts; (2) yellow, orange or red carotenoid-containing chromoplasts; (3) starch-storing amyloplasts; (4) oil-containing elaioplasts; (5) proplastids (plastid precursors found in most plant cells); and (6) etioplasts (partially developed chloroplasts that form in dark-grown seedlings). Each plastid creates multiple copies of the 75-250 kilo bases plastid genome. The number of genome copies per plastid is flexible, ranging from more than 1000 in rapidly dividing cells, which generally contain few plastids, to 100 or fewer in mature cells, where plastid divisions has given rise to a large number of plastids. The plastid genome contains about 100 genes encoding ribosomal and transfer ribonucleic acids (rRNAs and tRNAs) as well as proteins involved in photosynthesis and plastid gene transcription and translation. Most plants inherit the plastids from only one parent. Angiosperms generally inherit plastids from the mother, while many gymnosperms inherit plastids from the father. Algae also inherit plastids from only one parent. This fact allows for gene manipulation in plastids as a means of controlling inadvertent gene dispersion, a concern in genetically modified plant agriculture.

The various forms of plastid (amyloplasts, chromoplasts, etc.) have desirable properties as places to conduct reactions and to accumulate proteins or products of enzymes, and they can be exploited using the embodiments provided. Some syntheses other than photosynthesis are only carried out in plastids, probably because one or another feature of the organelle's environment does not exist elsewhere in the cell. Furthermore, the cytoplasm and chloroplast contain different proteases, and a protein might survive better in one compartment than in the other. A specific type of plastid might be a good place to accumulate certain proteins or their biosynthetic products that would be harmful if they were present in large amounts in the cytoplasm or in a plastid of a different type.

Mitochondria in plants, as in other eukaryotes, play an essential role in the cell as the major producers of ATP via oxidative phosphorylation in addition, mitochondria are involved in numerous other metabolic processes including the biosynthesis of amino acids, vitamin cofactors, fatty acids, and iron-sulphur clusters. Plant mitochondria also play crucial roles in many other aspects of plant development, performance, cell death and possess an array of unique properties which allow them to interact with the specialized features of plant cell metabolism. This includes regulation of oxidative stress during infection and pathogen attack and modulating plant responses as a means of survival during stresses such as cold temperatures, drought, and nutrient limitation. Furthermore, plant mitochondria and the accumulation of mutations in plant mitochondrial genomes, may serve as the cause of plant aging.

In comparison to plastid genomes, the size of plant mitochondrial genomes is quite variable. Furthermore, plant mitochondrial genomes can be variable even within the same plant cell, a term referred to as heteroplasmy. Owing to robust recombination rates, the plant mitochondrial genome is a highly complex structure composed of small circular and large circularly permuted DNA molecules. Plant mitochondrial genomes encode for a host of proteins and RNAs involved in various plant cell processes including oxidative phosphorylation. In the course of evolution, many organisms tackled the task of introducing macromolecules into living cells. Aside from the cell-specific, usually receptor-mediated or active uptake mechanisms, the general solution that has independently emerged in many lineages relies on peptides specifically evolved to interact with, and insert into lipid bilayer membranes. Thus, bacterial colicins, human porins, and protein transduction domains (PTDs) from diverse species share the motif of a positively charged alpha-helix, frequently with an amphipathic structure, which is capable of inserting into lipid membranes, and delivering larger cargoes intracellularly. Recent research reports confirm the successful use of PTDs fused to proteins for their delivery across biological boundaries, including the blood-brain barrier, and the placenta.

Another issue of great importance in the delivery of macromolecules in organisms is the need to protect them from proteolytic, nucleolytic and immune degradation and removal while traversing extracellular spaces. An often used approach is coating DNA with proteins capable of surviving the harsh journey to the target. Viral capsid proteins have been quite successful, yet for the purpose of DNA delivery in humans they suffer from a significant drawback—immunogenicity, the capacity to evoke a strong immune reaction greatly reducing the effectiveness of gene therapy.

Thus, there is a need for improved compositions and methods for the delivery of polynucleotides to the interior of a cell.

SUMMARY OF THE INVENTION

Non-viral polynucleotide delivery vehicles and methods of their use are provided. In general, the disclosure provides modified polynucleotide-binding proteins comprising a protein transduction domain operably linked to a targeting signal, for example a non-nuclear organelle targeting signal. One aspect provides a polypeptide comprising at least one HMG box domain, more typically at least two HMG box domains and optionally at least one protein transduction domain. The polypeptide can associate with a polynucleotide causing the polynucleotide to condense. The polypeptide can also coat the polynucleotide. Coating and/or condensing the polynucleotide helps protect the polynucleotide from degradation. The protein transduction domain helps the polypeptide-polynucleotide complex cross membranes and enter the interior of a cell or an organelle. The targeting signal helps direct the complex to a site of interest and thereby deliver the polynucleotide.

The disclosed compositions can be used to deliver polynucleotides to specific locations within a plant cell, including but not limited to plastids, plant mitochondria and plant nuclei. In some aspects, the polynucleotides encode a biosynthetic protein(s) or a protein(s) that compensates for resistance to environmental stress. Accordingly, some aspects provide methods for modifying plants.

DETAILED DESCRIPTION

1. Definitions

Figure 1:
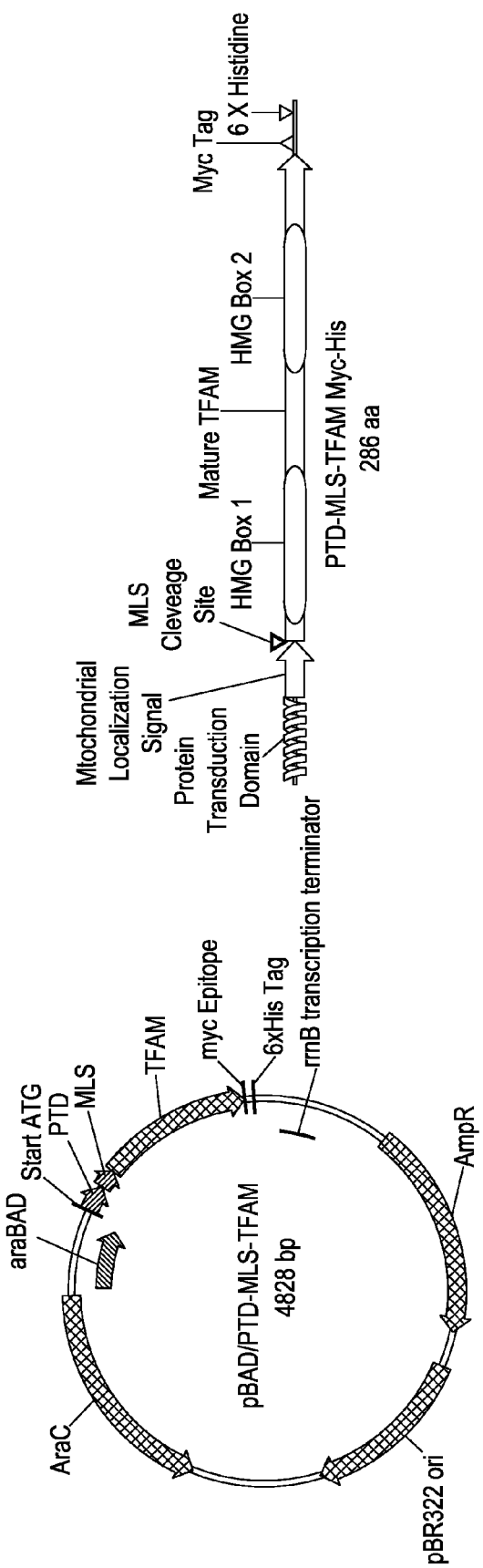
FIG. 1 is a diagram of one exemplary plasmid design (left) and exemplary protein structure (right) for TFAM with a PTD domain followed by a MLS.

In describing and claiming the disclosed subject matter, the following terminology will be used in accordance with the definitions set forth below.

The term "polypeptides" includes proteins and fragments thereof. Polypeptides are disclosed herein as amino acid residue sequences. Those sequences are written left to right in the direction from the amino to the carboxy terminus. In accordance with standard nomenclature, amino acid residue sequences are denominated by either a three letter or a single letter code as indicated as follows: Alanine (Ala, A), Arginine (Arg, R), Asparagine (Asn, N), Aspartic Acid (Asp, D), Cysteine (Cys, C), Glutamine (Gin, Q), Glutamic Acid (Glu, E), Glycine (Gly, G), Histidine (His, H), Isoleucine (Ile, I), Leucine (Leu, L), Lysine (Lys, K), Methionine (Met, M), Phenylalanine (Phe, F), Proline (Pro, P), Serine (Ser, S), Threonine (Thr, T), Tryptophan (Trp, W), Tyrosine (Tyr, Y), and Valine (Val, V).

"Variant" refers to a polypeptide or polynucleotide that differs from a reference polypeptide or polynucleotide, but retains essential properties. A typical variant of a polypeptide differs in amino acid sequence from another, reference polypeptide. Generally, differences are limited so that the sequences of the reference polypeptide and the variant are closely similar overall and, in many regions, identical. A variant and reference polypeptide may differ in amino acid sequence by one or more modifications (e.g., substitutions, additions, and/or deletions). A substituted or inserted amino acid residue may or may not be one encoded by the genetic code. A variant of a polypeptide may be naturally occurring such as an allelic variant, or it may be a variant that is not known to occur naturally.

Modifications and changes can be made in the structure of the polypeptides of in disclosure and still obtain a molecule having similar characteristics as the polypeptide (e.g., a conservative amino acid substitution). For example, certain amino acids can be substituted for other amino acids in a sequence without appreciable loss of activity. Because it is the interactive capacity and nature of a polypeptide that defines that polypeptide's biological functional activity, certain amino acid sequence substitutions can be made in a polypeptide sequence and nevertheless obtain a polypeptide with like properties.

In making such changes, the hydropathic index of amino acids can be considered. The importance of the hydropathic amino acid index in conferring interactive biologic function on a polypeptide is generally understood in the art. It is known that certain amino acids can be substituted for other amino acids having a similar hydropathic index or score and still result in a polypeptide with similar biological activity. Each amino acid has been assigned a hydropathic index on the basis of its hydrophobicity and charge characteristics. Those indices are: isoleucine (+4.5); valine (+4.2); leucine (+3.8); phenylalanine (+2.8); cysteine/cysteine (+2.5); methionine (+1.9); alanine (+1.8); glycine (−0.4); threonine (−0.7); serine (−0.8); tryptophan (−0.9); tyrosine (−1.3); proline (−1.6); histidine (−3.2); glutamate (−3.5); glutamine (−3.5); aspartate (−3.5); asparagine (−3.5); lysine (−3.9); and arginine (−4.5).

It is believed that the relative hydropathic character of the amino acid determines the secondary structure of the resultant polypeptide, which in turn defines the interaction of the polypeptide with other molecules, such as enzymes, substrates, receptors, antibodies, antigens, and the like. It is known in the art that an amino acid can be substituted by another amino acid having a similar hydropathic index and still obtain a functionally equivalent polypeptide. In such changes, the substitution of amino acids whose hydropathic indices are within ±2 is preferred, those within ±1 are particularly preferred, and those within ±0.5 are even more particularly preferred.

Substitution of like amino acids can also be made on the basis of hydrophilicity, particularly, where the biological functional equivalent polypeptide or peptide thereby created is intended for use in immunological embodiments. The following hydrophilicity values have been assigned to amino acid residues: arginine (+3.0); lysine (+3.0); aspartate (+3.0±1); glutamate (+3.0±1); serine (+0.3); asparagine (+0.2); glutamnine (+0.2); glycine (0); proline (−0.5±1); threonine (−0.4); alanine (−0.5); histidine (−0.5); cysteine (−1.0); methionine (−1.3); valine (−1.5); leucine (−1.8); isoleucine (−1.8); tyrosine (−2.3); phenylalanine (−2.5); tryptophan (−3.4). It is understood that an amino acid can be substituted for another having a similar hydrophilicity value and still obtain a biologically equivalent, and in particular, an immunologically equivalent polypeptide. In such changes, the substitution of amino acids whose hydrophilicity values are within ±2 is preferred, those within ±1 are particularly preferred, and those within ±0.5 are even more particularly preferred.

As outlined above, amino acid substitutions are generally based on the relative similarity of the amino acid side-chain substituents, for example, their hydrophobicity, hydrophilicity, charge, size, and the like. Exemplary substitutions that take various of the foregoing characteristics into consideration are well known to those of skill in the art and include (original residue: exemplary substitution): (Ala: Gly, Ser), (Arg: Lys), (Asn: Gln, His), (Asp: Glu, Cys, Ser), (Gin: Asn), (Gin: Asp), (Gly: Ala), (His: Asn, Gln), (Ile: Leu, Val), (Leu: Ile, Val), (Lys: Arg), (Met: Leu, Tyr), (Ser: Thr), (Thr: Ser), (Tip: Tyr), (Tyr: Trp, Phe), and (Val: Ile, Leu). Embodiments of this disclosure thus contemplate functional or biological equivalents of a polypeptide as set forth above. In particular, embodiments of the polypeptides can include variants having about 50%, 60%, 70%, 80%, 90%, and 95% sequence identity to the polypeptide of interest.

"Identity," as known in the art, is a relationship between two or more polypeptide sequences, as determined by comparing the sequences. In the art, "identity" also means the degree of sequence relatedness between polypeptide as determined by the match between strings of such sequences. "Identity" and "similarity" can be readily calculated by known methods, including, but not limited to, those described in (Computational Molecular Biology, Lesk, A. M., Ed., Oxford University Press, New York, 1988; Biocomputing: Informatics and Genome Projects, Smith, D. W., Ed., Academic Press, New York, 1993; Computer Analysis of Sequence Data, Part I, Griffin, A. M., and Griffin, H. G., Eds., Humana Press, New Jersey, 1994; Sequence Analysis in Molecular Biology, von Heinje, G., Academic Press, 1987; and Sequence Analysis Primer, Gribskov, M and Devereux, J., Eds., M Stockton Press, New York, 1991; and Carillo, H., and Lipman, D., SIAM J Applied Math., 48: 1073 (1988).

Preferred methods to determine identity are designed to give the largest match between the sequences tested. Methods to determine identity and similarity are codified in publicly available computer programs. The percent identity between two sequences can be determined by using analysis software (i.e., Sequence Analysis Software Package of the Genetics Computer Group, Madison Wis.) that incorporates the Needelman and Wunsch, (J. Mal. Biol., 48: 443-453, 1970) algorithm (e.g., NBLAST, and XBLAST). The default parameters are used to determine the identity for the polypeptides of the present disclosure.

By way of example, a polypeptide sequence may be identical to the reference sequence, that is be 100% identical, or it may include up to a certain integer number of amino acid alterations as compared to the reference sequence such that the % identity is less than 100%. Such alterations are selected from: at least one amino acid deletion, substitution, including conservative and non-conservative substitution, or insertion, and wherein said alterations may occur at the amino- or carboxy-terminal positions of the reference polypeptide sequence or anywhere between those terminal positions, interspersed either individually among the amino acids in the reference sequence or in one or more contiguous groups within the reference sequence. The number of amino acid alterations for a given % identity is determined by multiplying the total number of amino acids in the reference polypeptide by the numerical percent of the respective percent identity (divided by 100) and then subtracting that product from said total number of amino acids in the reference polypeptide.

As used herein, the term "low stringency" refers to conditions that permit a polynucleotide or polypeptide to bind to another substance with little or no sequence specificity.

As used herein, the term "purified" and like terms relate to the isolation of a molecule or compound in a form that is substantially free (at least 60% free, preferably 75% free, and most preferably 90% free) from other components normally associated with the molecule or compound in a native environment.

As used herein, the term "pharmaceutically acceptable carrier" encompasses any of the standard pharmaceutical carriers, such as a phosphate buffered saline solution, water and emulsions such as an oil/water or water/oil emulsion, and various types of wetting agents.

As used herein, the term "treating" includes alleviating the symptoms associated with a specific disorder or condition and/or preventing or eliminating said symptoms.

"Operably linked" refers to a juxtaposition wherein the components are configured so as to perform their usual function. For example, control sequences or promoters operably linked to a coding sequence are capable of effecting the expression of the coding sequence, and an organelle localization sequence operably linked to protein will direct the linked protein to be localized at the specific organelle.

"Localization Signal or Sequence or Domain" or "Targeting Signal or Sequence or Domain" are used interchangeably and refer to a signal that directs a molecule to a specific cell, tissue, organelle, or intracellular region. The signal can be polynucleotide, polypeptide, or carbohydrate moiety or can be an organic or inorganic compound sufficient to direct an attached molecule to a desired location. Exemplary organelle localization signals include nuclear localization signals known in the art and other organelle localization signals known in the art such as those provided in Tables 1 and 2 and described in Emanuelson et al., Predicting Subcellular Localization of Proteins Based on Their N-terminal Amino Acid Sequence. *Journal of Molecular Biology.* 300(4):1005-16, 2000 Jul. 21, and in Cline and Henry, Import and Routing of Nucleus-encoded Chloroplast Proteins. *Annual Review of Cell & Developmental Biology.* 12:1-26, 1996, the disclosures of which are incorporated herein by reference in their entirety. It will be appreciated that the entire sequence listed in Tables 1 and 2 need not be included, and modifications including truncations of these sequences are within the scope of the disclosure provided the sequences operate to direct a linked molecule to a specific organelle. Organelle localization signals of the present disclosure can have 80 to 100% homology to the sequences in Tables 1 and 2. One class of suitable organelle localization signals include those that do not interact with the targeted organelle in a receptor:ligand mechanism. For example, organelle localization signals include signals having or conferring a net charge, for example a positive charge. Positively charged signals can be used to target negatively charged organelles such as the chloroplast and plant mitochondrion. Negatively charged signals can be used to target positively charged organelles.

"Protein Transduction Domain" or PTD refers to a polypeptide, polynucleotide, carbohydrate, or organic or inorganic compounds that facilitates traversing a lipid bilayer, micelle, cell membrane, organelle membrane, or vesicle membrane. A PTD attached to another molecule facilitates the molecule traversing membranes, for example going from extracellular space to intracellular space, or cytosol to within an organelle. Exemplary PTDs include but are not limited to HIV TAT YGRKKRRQRRR (SEQ. ID NO. 1) or RKKRRQRRR (SEQ. ID NO. 2); 11 Arginine residues, or positively charged polypeptides or polynucleotides having 8-15 residues, preferably 9-11 residues.

As used herein, the term "exogenous DNA" or "exogenous nucleic acid sequence" or "exogenous polynucleotide" refers to a nucleic acid sequence that was introduced into a cell or organelle from an external source. Typically the introduced exogenous sequence is a recombinant sequence.

As used herein, the term "transfection" refers to the introduction of a nucleic acid sequence into the interior of a membrane enclosed space of a living cell, including introduction of the nucleic acid sequence into the cytosol of a cell as well as the interior space of a mitochondria, nucleus or chloroplast. The nucleic acid may be in the form of naked DNA or RNA, associated with various proteins or the nucleic acid may be incorporated into a vector.

As used herein, the term "vector" is used in reference to a vehicle used to introduce a nucleic acid sequence into a cell.

A viral vector is virus that has been modified to allow recombinant DNA sequences to be introduced into host cells or cell organelles.

As used herein, the term "organelle" refers to cellular membrane bound structures such as the plastid, mitochondrion, and nucleus. The term "organelle" includes natural and synthetic organelles.

As used herein, the term "plastid" refers to any cellular membrane bound structure present in a plant cell, which possesses its own DNA. Chloroplasts, Etioplasts, Chromoplasts, Leucoplast, Amyloplasts, Statoliths, Elaioplasts and Proteinoplasts are examples of plastids.

As used herein, the term "non-nuclear organelle" refers to any cellular membrane bound structure present in a cell, except the nucleus.

As used herein, the term "polynucleotide" generally refers to any polyribonucleotide or polydeoxyribonucleotide, which may be unmodified RNA or DNA or modified RNA or DNA. Thus, for instance, polynucleotides as used herein refers to, among others, single- and double-stranded DNA, DNA that is a mixture of single- and double-stranded regions, single- and double-stranded RNA, and RNA that is mixture of single- and double-stranded regions, hybrid molecules comprising DNA and RNA that may be single-stranded or, more typically, double-stranded or a mixture of single- and double-stranded regions. The term "nucleic acid" or "nucleic acid sequence" also encompasses a polynucleotide as defined above.

In addition, polynucleotide as used herein refers to triple-stranded regions comprising RNA or DNA or both RNA and DNA. The strands in such regions may be from the same molecule or from different molecules. The regions may include all of one or more of the molecules, but more typically involve only a region of some of the molecules. One of the molecules of a triple-helical region often is an oligonucleotide.

As used herein, the term polynucleotide includes DNAs or RNAs as described above that contain one or more modified bases. Thus, DNAs or RNAs with backbones modified for stability or for other reasons are "polynucleotides" as that term is intended herein. Moreover, DNAs or RNAs comprising unusual bases, such as inosine, or modified bases, such as tritylated bases, to name just two examples, are polynucleotides as the term is used herein.

It will be appreciated that a great variety of modifications have been made to DNA and RNA that serve many useful purposes known to those of skill in the art. The term polynucleotide as it is employed herein embraces such chemically, enzymatically or metabolically modified forms of polynucleotides, as well as the chemical forms of DNA and RNA characteristic of viruses and cells, including simple and complex cells, inter alia.

"Oligonucleotide(s)" refers to relatively short polynucleotides. Often the term refers to single-stranded deoxyribonucleotides, but it can refer as well to single- or double-stranded ribonucleotides, RNA:DNA hybrids and double-stranded DNAs, among others.

The term "episome" refers to a polynucleotide sufficient to allow recombination into an organelle genome, optionally including inserted genes, regulatory regions or coding regions.

The term "multicistronic" refers to a polynucleotide possessing more than one coding region to produce more than one protein from the same polynucleotide.

The term "operon" refers to a polynucleotide possessing at least one coding region transcribed from a single promoter.

2. Modified Polynucleotide Binding or Polynucleotide-Packaging Polypeptides

A. Polynucleotide Binding Domain

The compositions and methods for the delivery of cargo, for example a polynucleotide, provided herein include polynucleotide-binding polypeptides or polynucleotide-packaging polypeptides optionally having a PTD and optionally having a targeting signal or domain. The modified or recombinant polypeptide can be any polypeptide known to bind or package a polynucleotide or a variant thereof. The recombinant polypeptide can be used as therapeutic agent either alone or in combination with a polynucleotide. In one embodiment, the polynucleotide-binding polypeptide includes at least a portion of a member of the high mobility group (HMG) of proteins, in particular at least one HMG box domain. Generally, the HMG domain includes a global fold of three helices stabilized in an 'L-shaped' configuration by two hydrophobic cores. The high mobility group chromosomal proteins HMG1 or HMG2, which are common to all eukaryotes, bind DNA in a non-sequence-specific fashion, for example to promote chromatin function and gene regulation. They can interact directly with nucleosomes and are believed to be modulators of chromatin structure. They are also important in activating a number of regulators of gene expression, including p53, Hox transcription factors and steroid hormone receptors, by increasing their affinity for DNA. HMG proteins include HMG-1/2, HMG-I(Y) and HMG-14/17.

The HMG-1/2-box proteins can be further distinguished into three subfamilies according to the number of HMG domains present in the protein, their specific of sequence recognition and their evolutionary relationship. The first group contains chromosomal proteins bound to DNA with no sequence specificity (class I, HMG1 and HMG2), the second contains ribosomal and mitochondrial transcription factors which show sequence specificity in the presence of another associating factor when bound with DNA (class II, yeast ARS binding protein ABF-2, UBF and mitochondrial transcription factor mtTF-1), and the third contains gene-specific transcription factors which show sequence specific DNA binding (class III, lymphoid enhancer-binding factors LEF-1 and TCF-1; the mammalian sex-determining factor SRY, and the closely related SOX proteins; and the fungal regulatory proteins Mat-MC, Mat-a1, Ste11 and Rox1). The HMG1/2-box DNA binding domain is about 75 to about 80 amino acids and contains highly conserved proline, aromatic and basic residues. Common properties of HMG domain proteins include interaction with the minor groove of the DNA helix, binding to irregular DNA structure, and the capacity to modulate DNA structure by bending.

SOX (SRY-type HMG box) proteins have critical functions in a number of developmental processes, including sex determination, skeleton formation, pre-B and T cell development and neural induction. SOX9 plays a direct role during chondrogenesis by binding and activating the chondrocyte-specific enhancer of the Col2a1 gene. Loss of SOX9 gene function leads to the genetic condition known as Campomelic Dysplsia (CD), a form of dwarfism characterized by extreme skeletal malformation, and one in which three-quarters of XY individual are either intersexes or exhibit male to female sex reversal. There are more than 20 members cloned in SOX family. All of which contain an HMG domain, which can bind specifically to the double strand DNA motif and shares >50% identify with the HMG domain of SRY, the human testis-determining factor. The preferred DNA-binding site of SOX9 have been defined to be AGAACAATGG, which contains the SOX core-binding element (SCBE), AACAAT, flanking 5' AG and 3' GG nucleotides enhance binding by SOX9.

In one embodiment, the recombinant polynucleotide-binding protein has at least one HMG box domain, generally at least two, more particularly 2-5 HMG box domains. The HMG box domain can bind to an AT rich DNA sequence, for example, using a large surface on the concave face of the protein, to bind the minor groove of the DNA. This binding bends the DNA helix axis away from the site of contact. The first and second helices contact the DNA, their N-termini fitting into the minor groove whereas helix 3 is primarily exposed to solvent. Partial intercalation of aliphatic and aromatic residues in helix 2 occurs in the minor groove.

In other embodiments, the polynucleotide binding polypeptide can have at least one polynucleotide binding domain, typically two or more polynucleotide binding domains. The polynucleotide binding domains can be the same or different. For example, the polynucleotide-binding polypeptide can include at least on HMG box in combination with one or more DNA binding domains selected from the group consisting of an HMG box, homeodomain and POU domain; zinc finger domain such as $C_2H_2$ and $C_2C_2$; amphipathic helix domain such as leucine zipper and helix-loop-helix domains; and histone folds. The polynucleotide binding domain can be specific for a specific polynucleotide sequence, or preferably non-specifically binds to a polynucleotide. Alternatively, the polynucleotide-binding polypeptide can have more a combination of at least one polynucleotide binding domain that binds in a sequence specific manner and at least one polynucleotide binding-domain that binds DNA non-specifically.

Certain embodiments provide modified polynucleotide-binding polypeptides having a helix-turn-helix motif or at least a polynucleotide binding region of a helix-turn-helix protein. Helix-turn-helix proteins have a similar structure to bacterial regulatory proteins such as the 1 repressor and cro proteins, the lac repressor and so on which bind as dimers and their binding sites are palindromic. They contain 3 a helical regions separated by short turns which is why they are called helix-turn-helix proteins. One protein helix (helix 3) in each subunit of the dimer occupies the major groove of two successive turns of the DNA helix. Thus, in another embodiment, the disclosed polynucleotide-binding polypeptides can form dimers or other multi-component complexes, and have 1 to 3 helices.

In yet another embodiment, the modified polynucleotide-binding polypeptide includes a homeodomain or a portion of a homeodomain protein. Homeodomain proteins bind to a sequence of 180 base pairs initially identified in a group of genes called homeotic genes. Accordingly, the sequence was called the homeobox. The 180 bp corresponds to 60 amino acids in the corresponding protein. This protein domain is called the homeodomain. Homeodomain-containing proteins have since been identified in a wide range of organisms including vertebrates and plants. The homeodomain shows a high degree of sequence conservation. The homeodomain contains 4 α helical regions. Helices II and III are connected by 3 amino acids comprising a turn. This region has a very similar structure to helices II and III of bacterial DNA binding proteins.

Yet another embodiment provides a modified polynucleotide-binding polypeptide having a zinc finger domain or at least a portion of a zinc finger protein. Zinc finger proteins have a domain with the general structure: Phe (sometimes Tyr)-Cys-2 to 4 amino acids-Cys-3 amino acids-Phe (sometimes Tyr)-5 amino acids-Leu-2 amino acids-His-3 amino acids-His. The phenylalanine or tyrosine residues which occur at invariant positions are required for DNA binding. Similar sequences have been found in a range of other DNA binding proteins though the number of fingers varies. For example, the SP1 transcription factor which binds to the GC box found in the promoter proximal region of a number of genes has 3 fingers. This type of zinc finger which has 2 cysteines and 2 histidines is called a $C_2H_2$ zinc finger.

Another type of zinc finger which binds zinc between 2 pairs of cysteines has been found in a range of DNA binding proteins. The general structure of this type of zinc finger is: Cys-2 amino acids-Cys-13 amino acids-Cys-2 amino acids-Cys. This is called a $C_2C_2$ zinc finger. It is found in a group of proteins known as the steroid receptor superfamily, each of which has 2 $C_2C_2$ zinc fingers.

Another embodiment provides a modified polynucleotide-binding polypeptide having a leucine zipper or at least a portion of a leucine zipper protein. The first leucine zipper protein was identified from extracts of liver cells, and it was called C/EBP because it is an enhancer binding protein and it was originally thought to bind to the CAAT promoter proximal sequence. C/EBP will only bind to DNA as a dimer. The region of the protein where the two monomers join to make the dimer is called the dimerization domain. This lies towards the C-terminal end of the protein. When the amino acid sequence was examined it was found that a leucine residue occurs every seventh amino acid over a stretch of 35 amino acids. If this region were to form an a helix then all of these leucines would align on one face of the helix.

Because leucine has a hydrophobic side chain, one face of the helix is very hydrophobic. The opposite face has amino acids with charged side chains which are hydrophilic. The combination of hydrophobic and hydrophilic characteristics gives the molecule is amphipathic moniker. Adjacent to the leucine zipper region is a region of 20-30 amino acids which is rich in the basic (positively charged) amino acids lysine and arginine. This is the DNA binding domain—often referred to as the bZIP domain—the basic region of the leucine zipper. C/EBP is thought to bind to DNA by these bZIP regions wrapping round the DNA helix The leucine zipper—bZIP structure has been found in a range of other proteins including the products of the jun and fos oncogenes. Whereas C/EBP binds to DNA as a homodimer of identical subunits, fos cannot form homodimers at all and jun/jun homodimers tend to be unstable. However fos/jun heterodimers are much more stable. These fos/jun heterodimers correspond to a general transcription factor called AP1 which binds to a variety of promoters and enhancers and activates transcription. The consensus AP1 binding site is TGACTCA (SEQ. ID. NO.: 3) which is palindromic.

Another embodiment provides a modified polynucleotide-binding polypeptide having helix-loop-helix domain or a polynucleotide binding portion of a helix-loop-helix protein. Helix-loop-helix proteins are similar to leucine zippers in that they form dimers via amphipathic helices. They were first discovered as a class of proteins when a region of similarity was noticed between two enhancer binding proteins called E47 and E12. This conserved region has the potential to form two amphipathic separated by a loop hence helix-loop-helix. Next to the dimerization domain is a DNA binding domain, again rich in basic amino acids and referred to as the bHLH domain. These structures are also found in a number of genes required for development of the Drosophila nervous system—the Achaete-scute complex, and in a protein called MyoD which is required for mammalian muscle differentiation.

In still another embodiment, the modified polynucleotide binding polypeptide includes a histone polypeptide, a fragment of a histone polypeptide, or at least one histone fold.

Histone folds exist in histone polypeptides monomers assembled into dimers. Histone polypeptides include H2A, H2B, H3, and H4 which can form heterodimers H2A-2B and H3-H4. It will be appreciated that histone-like polypeptides can also be used in the disclosed compositions and methods. Histone-like polypeptides include, but are not limited to, HMf or the histone from *Methanothermous fervidus*, other archaeal histones known in the art, and histone-fold containing polypeptides such as MJ1647, CBF, TAFII or transcription factor IID, SPT3, and Dr1-DRAP (Sanderman, K. et al. (1998) CMLS. Cell. Mol. Life Sci. 54:1350-1364, which is incorporated by reference in its entirety).

One embodiment, among others, provides a non-histone polynucleotide-binding polypeptide, for example a polynucleotide-binding polypeptide comprising mitochondrial transcription factor A (TFAM) polypeptide, a variant thereof, or a fragment thereof sufficient to bind polynucleotides. Variant TFAM can have 80%, 85%, 90%, 95%, 99% or greater sequence identity with a reference TFAM, for example naturally occurring TFAM.

TFAM is a member of the high mobility group (HMG) of proteins having two HMG-box domains. TFAM as well as other HMG proteins bind, wrap, bend, and unwind DNA. Thus, embodiments of the present disclosure include polynucleotide binding polypeptides comprising one or more polynucleotide binding regions of the HMG family of proteins, and optionally induce a structural change in the polynucleotide when the polypeptide binds or becomes associated with the polynucleotide. By inducing a conformational change in the polynucleotide, the polypeptide packages the polynucleotide. It has been reported that TFAM binds to mitochondrial DNA in a ratio of 900:1 (Alam, T. I. et al. (2003) Nucleic Acid Res. 31(6):1640-1645). It will be appreciated that the amount of polynucleotide-binding polypeptide used in the compositions and methods disclosed herein can vary depending on the size and amount of the polynucleotide to be delivered. Suitable ratios of polynucleotide-binding polypeptide to base pairs of polynucleotide to be delivered include, but are not limited to, about 1:1 to 1:1,000; more preferably 1:100; even more preferably 1: about 10 to about 20 base pairs of polynucleotide to be delivered. It will also be appreciated that TFAM, another polynucleotide-binding polypeptide, or a combination of two or more polynucleotide-binding polypeptides can be added to a polynucleotide to wrap or cover the polynucleotide, and thereby package the polynucleotide and protected it from degradation.

TFAM can be modified to include a PTD and optionally a targeting signal. The targeting signal can include a sequence of monomers that facilitates the localization of the molecule to a specific tissue, cell, or organelle. The monomers can be amino acids, nucleotide or nucleoside bases, or sugar groups such as glucose, galactose, and the like which form carbohydrate targeting signals.

B. Protein Transduction Domain

The polynucleotide-binding polypeptide can be modified to include a protein transduction domain (PTD), also known as cell penetrating peptides (CPPS). PTDs are known in the art, and include but are not limited to small regions of proteins that are able to cross a cell membrane in a receptor-independent mechanism (Kabouridis, P. (2003) Trends in Biotechnology (11):498-503). Although several of PTDs have been documented, the two most commonly employed PTDs are derived from TAT (Frankel and Pabo, (1988) Cell, December 23; 55(6):1189-93) protein of HIV and Antennapedia transcription factor from Drosophila, whose PTD is known as Penetratin (Derossi et al., (1994) J Biol Chem. 269(14):10444-50).

The Antennapedia homeodomain is 68 amino acid residues long and contains four alpha helices (SEQ. ID NO. 4). Penetratin is an active domain of this protein which consists of a 16 amino acid sequence derived from the third helix of Antennapedia. TAT protein (SEQ. ID NO. 5) consists of 86 amino acids and is involved in the replication of HIV-1. The TAT PTD consists of an 11 amino acid sequence domain (residues 47 to 57; YGRKKRRQRRR (SEQ. ID. NO. 1)) of the parent protein that appears to be critical for uptake. Additionally, the basic domain Tat(49-57) or RKKRRQRRR (SEQ. ID NO. 2) has been shown to be a PTD. In the current literature TAT has been favored for fusion to proteins of interest for cellular import. Several modifications to TAT, including substitutions of Glutatmine to Alanine, i.e., Q→A, have demonstrated an increase in cellular uptake anywhere from 90% (Wender et al. 2000) to up to 33 fold in mammalian cells. (Ho et al. (2001) Cancer Res. 61(2):474-7) The most efficient uptake of modified proteins was revealed by mutagenesis experiments of TAT-PTD, showing that an 11 arginine stretch was several orders of magnitude more efficient as an intercellular delivery vehicle. Thus, some embodiments include PTDs that are cationic or amphipathic. Additionally exemplary PTDs include but are not limited to poly-Arg-RRRRRRR (SEQ. ID. NO.: 6); PTD-5-RRQRRTSKLMKR (SEQ. ID. NO.: 7); Transportan GWTLNSAGYLLGKINLKALAALAKKIL (SEQ. ID. NO.: 8); KALA-WEAKLAKALAKALA-KHLAKALAKALKCEA (SEQ. ID. NO.: 9); and RQIKIW-FQNRRMKWKK (SEQ. ID. NO.: 207).

C. Targeting Signal or Domain

In still other embodiments, the modified polynucleotide-binding polypeptide is optionally modified to include a targeting signal or domain. The targeting signal or sequence can be specific for a tissue, organ, cell, organelle, non-nuclear organelle, or cellular compartment. For example, the compositions disclosed herein can be modified with galactosyl-terminating macromolecules to target the compositions to the liver or to liver cells. The modified compositions selectively enter hepatocytes after interaction of the carrier galactose residues with the asialoglycoprotein receptor present in large amounts and high affinity only on these cells. Moreover, the compositions disclosed here can be targeted to specific intracellular regions, compartments, or organelles.

Additional embodiments of the present disclosure are directed to specifically delivering polynucleotides to intracellular compartments or organelles, both nuclear and non-nuclear. The polynucleotides can encode a polypeptide or interfere with the expression of a different polynucleotide. Eukaryotic cells contain membrane bound structures or organelles. Organelles can have single or multiple membranes and exist in both plant and animal cells. Depending on the function of the organelle, the organelle can consist of specific components such as proteins and cofactors. The polynucleotides delivered to the organelle can encode polypeptides that can enhance or contribute to the functioning of the organelle. Some organelles, such as mitochondria and plastids, contain their own genome. Nucleic acids are replicated, transcribed, and translated within these organelles. Proteins are imported and metabolites are exported. Thus, there is an exchange of material across the membranes of organelles. In some embodiments, polynucleotides encoding plastid polypeptides are specifically delivered to plastids.

Exemplary organelles include the nucleus, mitochondrion, plastid, lysosome, peroxisome, Golgi, endoplasmic reticulum, and nucleolus. Synthetic organelles can be formed from lipids and can contain specific proteins within the lipid membranes. Additionally, the content of synthetic organelles can be manipulated to contain components for the translation of nucleic acids.

1. Nuclear Localization Signals

Compositions disclosed herein can include one or more nuclear localization signals. Most proteins transported across the nuclear envelope contain a nuclear localization signal (NLS). The NLS is recognized by a nuclear import complex, enabling active transport to the nucleus. Even the transport of small proteins that can diffuse through the nuclear pore is increased by an NLS. NLS domains are known in the art and include for example, SV 40 T antigen or a fragment thereof, such as PKKKRKV (SEQ. ID. NO.: 10). The NLS can be simple cationic sequences of about 4 to about 8 amino acids, or can be bipartite having two interdependent positively charged clusters separated by a mutation resistant linker region of about 10-12 amino acids. The cauliflower mosaic virus (CMV) major capsid protein, CP, possesses an amino-terminal NLS. Additional representative NLS include but are not limited to GKKRSKV (SEQ. ID. NO.: 11); KSRKRKL (SEQ. ID. NO.: 12); KRPAATKKAGQAKKKKLDK (SEQ. ID. NO.: 13); RKKRKTEEESPLKDKAKKSK (SEQ. ID. NO.: 14); KDCVMNKHHRNRCQYCRLQR (SEQ. ID. NO.: 15); PAAKRVKLD (SEQ. ID. NO.: 16); and KKYEN-VVIKRSPRKRGRPRK (SEQ. ID. NO.: 17). Additionally, it is known in the art that animal and yeast NLS function in plants.

2. Mitochondria Targeting

In other embodiments of the present disclosure, modified polynucleotide-binding polypeptides are disclosed that specifically deliver polynucleotides to mitochondria. Mitochondria contain the molecular machinery for the conversion of energy from the breakdown of glucose into adenosine triphosphate (ATP). The energy stored in the high energy phosphate bonds of ATP is then available to power cellular functions. Mitochondria are mostly protein, but some lipid, DNA and RNA are present. These generally spherical organelles have an outer membrane surrounding an inner membrane that folds (cristae) into a scaffolding for oxidative phosphorylation and electron transport enzymes. Most mitochondria have flat shelf-like cristae, but those in steroid secreting cells may have tubular cristae. The mitochondrial matrix contains the enzymes of the citric acid cycle, fatty acid oxidation and mitochondrial nucleic acids.

Mitochondrial DNA is double stranded and circular. Mitochondrial RNA comes in the three standard varieties; ribosomal, messenger and transfer, but each is specific to the mitochondria. Some protein synthesis occurs in the mitochondria on mitochondrial ribosomes that are different than cytoplasmic ribosomes. Other mitochondrial proteins are made on cytoplasmic ribosomes with a signal peptide that directs them to the mitochondria. The metabolic activity of the cell is related to the number of cristae and the number of mitochondria within a cell. Cells with high metabolic activity have many well developed mitochondria. New mitochondria are formed from preexisting mitochondria when they grow and divide.

The inner membranes of mitochondria contain a family of proteins of related sequence and structure that transport various metabolites across the membrane. Their amino acid sequences have a tripartite structure, made up of three related sequences about 100 amino acids in length. The repeats of one carrier are related to those present in the others and several characteristic sequence features are conserved throughout the family.

Targeting specific polynucleotides to organelles can be accomplished by modifying the disclosed compositions to express specific organelle targeting signals. These sequences target specific organelles, but in some embodiments the interaction of the targeting signal with the organelle does not occur through a traditional receptor:ligand interaction. The eukaryotic cell comprises a number of discrete membrane bound compartments, or organelles. The structure and function of each organelle is largely determined by its unique complement of constituent polypeptides. However, the vast majority of these polypeptides begin their synthesis in the cytoplasm. Thus organelle biogenesis and upkeep require that newly synthesized proteins can be accurately targeted to their appropriate compartment. This is often accomplished by amino-terminal signaling sequences, as well as post-translational modifications and secondary structure. For plant mitochondria, several amino-terminal targeting signals have been deduced. Genes and proteins having mitochondrial localization signals are included, in part, in Table 1. Additionally, it is known in the art that animal and yeast mitochondrial targeting signals function in plants.

In one embodiment, the organelle targeting signal can contain at least two, preferably 5-15, most preferably about 11 charged groups, causing the targeting signal to be drawn to organelles having a net opposite charge. In another embodiment, the targeting signal can contain a series of charged groups that cause the targeting signal to be transported into an organelle either against or down an electromagnetic potential gradient. Suitable charged groups are groups that are charged under intracellular conditions such as amino acids with charged functional groups, amino groups, nucleic acids, and the like. Mitochondrial localization/targeting signals generally consist of a leader sequence of highly positively charged amino acids. This allows the protein to be targeted to the highly negatively charged mitochondria. Unlike receptor:ligand approaches that rely upon stochastic Brownian motion for the ligand to approach the receptor, the mitochondrial localization signal of some embodiments is drawn to mitochondria because of charge.

In order to enter the mitochondria, a protein generally must interact with the mitochondrial import machinery, consisting of the Tim and Tom complexes (Translocase of the Inner/Outer Mitochondrial Membrane). With regard to the mitochondrial targeting signal, the positive charge draws the linked protein to the complexes and continues to draw the protein into the mitochondria. The Tim and Tom complexes allow the proteins to cross the membranes. Accordingly, one embodiment of the present disclosure delivers compositions of the present disclosure to the inner mitochondrial space utilizing a positively charged targeting signal and the mitochondrial import machinery. In another embodiment, PTD-linked polypeptides containing a mitochondrial localization signal do not seem to utilize the TOM/TIM complex for entry into the mitochondrial matrix, see Del Gaizo et al. (2003) Mol Genet Metab. 80(1-2):170-80.

Given the importance of mitochondria for plant life, embodiments of the present disclosure also encompasses the manipulation of the mitochondrial genome to supply novel biosynthetic and environmental and chemical resistance routes. Furthermore, the ability to introduce exogenous genes may lead to plants with increased viability in otherwise hostile environments and increased efficiency of oxidative phosphorylation. Since plant mitochondria are involved in plant defense mechanisms, other embodiments include the modification of plant mitochondrial genomes to provide increased resistance or susceptibility to infectious pathogens. Furthermore, the expression of exogenous genes within the mitochondria is believed to circumvent crucial photosynthetic activities present in either the nucleus or plastid of the plant cell. Thus, other embodiments are directed to the transfection of mitochondria for more effective biosynthesis strategies for commercial compounds. In one embodiment, the polynucleotide encodes at least one protein with anti-microbial properties for expression in the plant. The protein may comprise an antibiotic. Additionally, a recombinant polynucleotide encoding at least one enzyme for converting hard-to-ferment sugars to more easily fermentable sugars for expression in the plant is utilized. In another embodiment, the polynucleotide encodes one or more enzymes capable of modulating the cellulose content of the transgenic plant. In one embodiment, the polynucleotide encodes for at least one protein promoting starch hydrolysis. In another embodiment, the polynucleotide encodes for proteins causing the plant to absorb environmental pollutants such as a metalloid such as arsenic or selenium, a heavy metal such as lead, chromium, cadmium, zinc, copper, or uranium, or a persistent organic pollutant such as DDT or PCBs.

3. Plastid Targeting

In another embodiment, modified compositions disclosed herein specifically deliver polynucleotides to plastids by including a plastid localization signal or domain. For plastids, several amino-terminal targeting signals have been deduced and are included, in part, in Table 2. The plastid is the genus of plant organelles of which a chloroplast is a specific species. A chloroplast is a photosynthetic organelle in eukaryotes with a double surrounding membrane. The fluid inside the double-membrane is called the stroma. The chloroplast has a nucleoid region to house its circular, naked DNA. The stroma is also the site of the Calvin Cycle. The Calvin Cycle is the series of enzyme-catalyzed chemical reactions that produce carbohydrates and other compounds from carbon dioxide.

Within the stroma are tiny membrane sacs called thylakoids. The sacs are stacked in groups. Each group is called a granum. There are many grana in each chloroplast. The thylakoid membranes are the site of photosynthetic light reactions. The thylakoids have intrinsic and extrinsic proteins, some with special prosthetic groups, allowing for electrons to be moved from protein complex to protein complex. These proteins constitute an electron transport system sometimes known as the Z-scheme.

The prosthetic group for two critical membrane proteins (P680 and P700) is a chlorophyll a pigment molecule. These chlorophyll-binding proteins give the thylakoids an intense green color. The many thylakoids in a chloroplast give the chloroplast a green color. The many chloroplasts in a leaf mesophyll cell give that cell a green color. The many mesophyll cells in a leaf give the leaf a green color. The chlorophyll molecule absorbs light energy and an electron is boosted within the electron cloud in a resonating chemical structure surrounding a magnesium ion. This excited electron is removed by the surrounding electron transport proteins in the membrane. The movement of these electrons, and accompanying protons, results ultimately in the trapping of energy in a phosphate bond in ATP. The thylakoid is thus the location for light absorption and ATP synthesis. The stroma uses the ATP to store the trapped energy in carbon-carbon bonds of carbohydrates. Some chloroplasts show developing starch grains. These represent complex polymers of carbohydrates for long-term storage.

Given the bioenergetic functions of plastids, the ability to introduce exogenous genes may lead to plants with increased viability in otherwise hostile environments and increased efficiency of photosynthesis. Furthermore, the expression of exogenous genes within the chloroplasts is believed to be significantly more efficient in chloroplasts relative the expression of exogenous genes introduced into the nucleus of the cell. Thus, other embodiments are directed to the transfection of chloroplasts for more effective biosynthesis strategies for commercial compounds. In one embodiment, the polynucleotide encodes at least one protein with anti-microbial properties for expression in the plant. The protein may comprise an antibiotic. Additionally, a recombinant polynucleotide encoding at least one enzyme for converting hard-to-ferment sugars to more easily fermentable sugars for expression in the plant is utilized. In another embodiment, the polynucleotide encodes one or more enzymes capable of modulating the cellulose content of the transgenic plant. In one embodiment, the polynucleotide encodes for at least one protein promoting starch hydrolysis. In another embodiment, the polynucleotide encodes for proteins causing the plant to absorb environmental pollutants such as a metalloid such as arsenic or selenium, a heavy metal such as lead, chromium, cadmium, zinc, copper, or uranium, or a persistent organic pollutant such as DDT or PCBs.

4. Modified Polynucleotide-Binding Polypeptide:Polynucleotide Complexes

Modified polynucleotide-binding polypeptides having a protein transduction domain, and optionally, a targeting signal can be combined with a polynucleotide of interest to form a polypeptide-polynucleotide complex. For example, the modified polypeptide can reversibly bind the polynucleotide of interest. The binding or interaction between the modified polypeptide and the polynucleotide of interest is strong enough to protect the polynucleotide from degradation but reversible so that the polynucleotide maintains its biological activity once it has been delivered to the cell or organelle. The biological activity of the polynucleotide can include expressing the polypeptide encoded by the polynucleotide or the enzymatic activity of the polynucleotide if it is a ribozyme or DNAzyme.

In certain embodiments, one or more of the disclosed polynucleotide binding proteins can be combined with a polynucleotide of interest to package the polynucleotide for delivery into a cell. In particular, large polynucleotides having for example at least 10 kb, typically at least 16 kb to about 20 kb, or at least 30 kb can be packaged using the disclosed polypeptides. The polynucleotide binding protein can be added to a polynucleotide in amounts sufficient to package or condense the polynucleotide for delivery to a cell or host. The polypeptide can be added to the polynucleotide in a ratio of about 1 polypeptide to about 10 to about 100 nucleotides.

Another embodiment provides a method for transfecting a plant organelle by combining a polynucleotide-binding polypeptide, for example TFAM, with a polynucleotide to be delivered and an amount of a lipid and/or polyamine to form a complex and contacting a cell, for example a plant cell, with the complex. The polynucleotide-binding protein optionally includes a PTD and optionally a targeting signal. The lipid and/or polyamine can be branched or unbranched, saturated or unsaturated, and typically has a carbon chain length of about 6 to about 50 carbons, more typically about 10 to about 30 carbons, even more typically about 15 to about 20 carbons. A nuclease can also be delivered to the non-nuclear organelle. The nuclease can be selected so that it cleaves endogenous nucleic acids, but does not cleave the heterologous nucleic acids that are introduced into the non-nuclear organelle. This embodiment allows for the creation of homoplasmic plastid and mitochondrial plants. Alternatively, a transfected non-nuclear organelle, for example a mitochondrion or plastid, can have a nuclease delivered to it wherein the nuclease is selected so that it cleaves the transfected nucleic acids or the heterologous nucleic acids in the non-nuclear organelle sufficient to replace the endogenous nucleic acids.

In one embodiment, the polynucleotide of interest is operably linked to a promoter or other regulatory elements known in the art. Thus, the polynucleotide can be a vector such as an expression vector. The engineering of polynucleotides for expression in a prokaryotic or eukaryotic system may be performed by techniques generally known to those of skill in recombinant expression. It is believed that virtually any expression system may be employed in the expression of the disclosed nucleic and amino sequences.

An expression vector typically comprises one of the disclosed compositions under the control of one or more promoters. To bring a coding sequence "under the control of" a promoter, one positions the 5' end of the translational initiation site of the reading frame generally between about 1 and 50 nucleotides "downstream" of (i.e., 3' of) the chosen promoter. The "upstream" promoter stimulates transcription of the inserted DNA and promotes expression of the encoded recombinant protein. This is the meaning of "recombinant expression" in the context used here.

Many standard techniques are available to construct expression vectors containing the appropriate nucleic acids and transcriptional/translational control sequences in order to achieve protein or peptide expression in a variety of host-expression systems. Cell types available for expression include, but are not limited to, bacteria, such as E. coil and B. subtilis transformed with recombinant phage DNA, plasmid DNA or cosmid DNA expression vectors. It will be appreciated that any of these vectors may be packaged and delivered using one or more of the disclosed polynucleotide packaging polypeptides.

Expression vectors for use in plant cells ordinarily include an origin of replication (as necessary), a promoter located in front of the gene(s) to be expressed, along with any necessary ribosome binding sites, RNA splice sites, polyadenylation site, and transcriptional terminator sequences. The origin of replication may be provided either by construction of the vector to include an exogenous origin, such as may be derived from Cauliflower mosaic virus or other viral (e.g., Tobacco mosaic virus) source, or may be provided by the host cell chromosomal replication mechanism. If the vector is integrated into the host cell chromosome, the latter is often sufficient.

The promoters may be derived from the genome of plant cells (e.g., nuclear factor Y promoter) or from plant viruses (e.g., the CMV 35S promoter). Further, it is also possible, and may be desirable, to utilize promoter or control sequences normally associated with the desired gene sequence, provided such control sequences are compatible with the host cell systems.

A number of viral based expression systems may be utilized, for example, commonly used promoters are derived from CMV. The CMV 35S promoter is useful because it is robust in plant transformation and shows no tissue-specificity. Smaller or modified CMV 35S fragments may also be used, provided there is included the approximately 46 bp sequence extending from upstream of transcription initiation.

Specific initiation signals may also be required for efficient translation of the disclosed compositions. These signals include the ATG initiation codon and adjacent sequences. Exogenous translational control signals, including the ATG initiation codon, may additionally need to be provided. One of ordinary skill in the art would readily be capable of determining this need and providing the necessary signals. It is well known that the initiation codon must be in-frame (or in-phase) with the reading frame of the desired coding sequence to ensure translation of the entire insert. These exogenous translational control signals and initiation codons can be of a variety of origins, both natural and synthetic. The efficiency of expression may be enhanced by the inclusion of appropriate transcription enhancer elements or transcription terminators.

In eukaryotic expression, one will also typically desire to incorporate into the transcriptional unit an appropriate polyadenylation site if one was not contained within the original cloned segment. Typically, the poly A addition site is placed about 30 to 2000 nucleotides "downstream" of the termination site of the protein at a position prior to transcription termination.

For long-term, high-yield production of recombinant proteins, stable expression is preferred. For example, cell lines that stably express constructs encoding proteins may be engineered. Rather than using expression vectors that contain viral origins of replication, host cells can be transformed with vectors controlled by appropriate expression control elements (e.g., promoter, enhancer, sequences, transcription terminators, polyadenylation sites, etc.), and a selectable marker. Following the introduction of foreign DNA, engineered cells may be allowed to grow for 1-2 days in an enriched medium, and then are switched to a selective medium. The selectable marker in the recombinant plasmid confers resistance to the selection and allows cells to stably integrate the plasmid into their chromosomes and grow to form foci, which in turn can be cloned and expanded into cell lines.

One embodiment provides a modified TFAM polypeptide having at least one PTD, and optionally, at least one targeting signal, for example, a mitochondrial localization signal or plastid localization signal. The modified TFAM can be associated with a polynucleotide of interest. The association can be accomplished in vitro or in vivo. TFAM can be mixed in amounts sufficient to wrap or bind the polynucleotide of interest. Typically, one molecule of TFAM wraps about 15 base pairs of a target polynucleotide. Enough modified TFAM can be added to a polynucleotide of interest to completely coat the exterior of the polynucleotide and/or to condense the polynucleotide. The polynucleotide is packaged so that the PTD and the optional targeting signal are displayed on the surface of the packaged polynucleotide. It will be appreciated that more than one polynucleotide can be packaged into a single complex using more than one modified polynucleotide-binding or packaging polypeptides.

The polynucleotide generally encodes a functional polypeptide, an antisense polynucleotide, an inhibitory RNA, or an entire operon and is packaged with the modified polynucleotide-binding polypeptide. At least one cell is contacted with the resulting complex either in vitro or in vivo. The protein transduction domain facilitates crossing the cell's outer membrane and delivers the polynucleotide to the interior of the cell. Once in the cytoplasm, an optional targeting signal or domain facilitates the localization of the polynucleotide of interest to a region of interest, for example to the mitochondrion or plastid. Once the polynucleotide of interest is delivered to its destination, it can be transcribed and ultimately translated. Alternatively, if the polynucleotide of interest is an antisense polynucleotide or enzymatic polynucleotide, the polynucleotide of interest can act at or near the deliver site, for example in the cytosol or in an organelle.

It has been reported that a major limitation of plant transformation technologies is the inability to introduce multiple genes in a single transformation. Many plastid genes are grouped in operons. Multicistronic mRNAs transcribed from these operons can be processed to produce mRNAs for single proteins. Introducing blocks of foreign genes in a single operon would avoid the complications inherent in putting one gene at a time into random locations. In one embodiment, a method of transfecting a host plastid with an operon possessing multiple genes is provided.

Another exemplary embodiment provides a method for transfecting a host, a host's cell, or a host's cellular organelle, for example the nucleus, mitochondria, or plastid, including the steps of contacting a host's cell with a complex including a modified polynucleotide-binding polypeptide having at least one PTD, and optionally, at least one targeting signal, in combination with a polynucleotide of interest. In one embodiment, the polynucleotide-polypeptide complex acts as a non-viral vector. Cells from one host can be transfected and administered to a second host, or a host's cells can be transfected and administered to the host. The transfection can occur in vivo or in vitro.

Suitable cells for transfection include cells capable of being transfected, for example eukaryotic or prokaryotic cells. The cells can be somatic, quiescent, embryonic, mitotic, stem cells, progenitor cells, germ line cells, pluripotent cells, totipotent cells, embryonic stem cells, heterologous cells, undifferentiated, partially differentiated, endoderm, mesoderm, ectoderm, immortalized, primary or cell wall denuded (proto) cultures. Organelle targeting signals of the present disclosure include polypeptides having a net positive charge, an NLS, and those listed in Tables 1 and 2. Suitable PTDs include but are not limited to HIV TAT YGRKKRRQRRR (SEQ. ID NO. 1) or RKKRRQRRR (SEQ. ID NO. 2); 11 Arginine residues, or positively charged polypeptides or polynucleotides having 8-15 residues, preferably 9-11 residues. The term non-nuclear organelle is intended to encompass all organelles other than the nucleus. It will be appreciated the disclosed compositions include a targeting signal, for example an organelle targeting signal, which causes the complex to associate with the organelle, typically to an organelle having a net negative charge or a region having a negative charge. In one embodiment, the association of the targeting signal with the organelle does not occur through a receptor:ligand interaction. The association of the organelle and complex can be ionic, non-covalent, covalent, reversible or irreversible. Exemplary complex:organelle associations include but are not limited to protein-protein, protein-carbohydrate, protein-nucleic acid, nucleic acid-nucleic acid, protein-lipid, lipid-carbohydrate, antibody-antigen, or avidin-biotin. The organelle targeting signal of the complex can be a protein, peptide, antibody, antibody fragment, lipid, carbohydrate, biotin, avidin, steptavidin, chemical group, or other ligand that causes specific association between the organelle and complex, preferably an electromagnetic association as between oppositely charged moieties.

The specific interaction between the introduced complex and its target, for example a specific type of cell or an organelle, can be accomplished by at least two methods. In one exemplary method a recombinant non-viral complex can include a recombinant polypeptide that expresses a targeting signal that interacts with the targeted the organelle. Preferably, the complex expresses a outer polypeptide that is specific to the target organelle. In another method the complex is modified to incorporate an exogenous targeting protein to which an organelle binds. Alternatively, a complex can include a modified recombinant polypeptide that specifically interacts with a desired cell, tissue, organ, or organelle, for example by expressing a amino acid sequence that interacts with the specific cell or organelle. It will be appreciated by those of skill in the art that the complex can be chemically modified to have a net positive or negative charge depending on the modification agent. For example, the complex can be coated with polylysine or other agents containing a primary amino group. Additionally, amino groups can be linked to the complex or compound containing amino groups can be linked to the complex. The linkage can be reversible or irreversible, covalent or non-covalent. Other charged groups for conferring a charge to a compound are known in the art and can be incorporated into the complex.

Nucleic acids including but not limited to polynucleotides, anti-sense nucleic acids, peptide nucleic acids, natural or synthetic nucleic acids, nucleic acids with chemically modified bases, RNA, DNA, RNA-DNA hybrids, enzymatic nucleic acids such as ribozymes and DNAzymes, native/endogenous genes and non-native/exogenous genes and fragments or combinations thereof, can be introduced into a cell or organelle of a host cell, in particular cells or organelles that can transcribe and or translate nucleic acids into proteins such as the nucleus, mitochondria and chloroplasts. In one embodiment of the present disclosure, all or part of the mitochondrial or plasitd genome can be introduced into an organelle. The nucleic acids can be introduced into the organelle with the complex when the complex crosses the organelle membrane via protein transduction domains.

Another embodiment provides a method for transfecting cellular organelles, for example eukaryotic organelles, by contacting the cell with a complex including a polynucleotide-binding polypeptide in combination with a polynucleotide, wherein the polynucleotide-binding polypeptide includes a PTD and optionally, a targeting signal or domain. The targeting signal can be a polypeptide, modified or unmodified, displayed on the surface of the complex which enables the complex to specifically associate with the target cell or organelle. Exemplary targeting signals include, plastid localization signals, mitochondrial targeting signals including the targeting signals of the genes, proteins, and polypeptides listed in TABLE 1 and 2 and other signals having a net positive charge. Contacting a cell with the complex in a manner that introduces the complex or the polynucleotide into the cytosol of said cell. The complex can further associates with its specific target organelle or intracellular region of the cell and the polynucleotide can be introduced into the organelle. Introduction of the polynucleotide into the organelle can be accomplished by transducing the polynucleotide across organelle membranes via a protein transduction domain expressed on a surface of the complex.

Introduction of a polynucleotide into the cytosol of a eukaryotic cell, in an intact functional form, can be accomplished using standard techniques known to those skilled in the art or through modification of the recombinant polynucleotide-binding polypeptide with a protein transduction domains. Such transfection procedures include but are not limited to microinjection, electroporation, calcium chloride premeablization, polyethylene glycol permeabilization, protoplast fusion or cationic lipid premeablization. In one embodiment a polynucleotide-binding polypeptide is modified to include a Protein Transduction Domain that enables the polypeptide bound to a polynucleotide to be transduced across a lipid bilayer including a cellular membrane, organelle membrane, or plasma membrane. Suitable PTDs include but are not limited to an 11 Arginine PTD or Tat-PTD (SEQ. ID NOs. 3 or 4) and poly-Arg-RRRRRRR (SEQ. ID. NO.: 6); PTD-5-RRQRRTSKLMKR (SEQ. ID. NO.: 7); Transportan GWTLNSAGYLLGKINLKALAALAKKIL (SEQ. ID. NO.: 8); and KALA-WEAKLAKALAKALA-KHLAKALAKALKCEA (SEQ. ID. NO.: 9).

In accordance with one embodiment a method is provided for introducing exogenous nucleic acid sequences into a mitochondrion of a plant cell. Any mitochondrial transfection technique should ensure that a nucleic acid crosses three membranes (the plasma membrane and the outer and inner mitochondrial membranes), addresses the high copy of mtDNA molecules, and utilizes a minimal, circular mitochondrial replicon. In one embodiment of the present disclosure a recombinant polynucleotide-binding polypeptide is used as a delivery vehicle for introducing nucleic acid sequences into an organelle, for example the mitochondrion. The recombinant polypeptide packages the polynucleotides to prevent them from being degraded, and to condense the polynucleotides for delivery. Condensation of polynucleotides includes the ordered structure of polynucleotides under concentrated conditions.

In accordance with another embodiment a recombinant polynucleotide-binding polypeptide having a PTD and a mitochondrial targeting signal is used for mitochondrial transfection. This approach allows for direct manipulation of mtDNA and introduction of the circular genome at high-copy number. In one embodiment this method is used to manipulate or replace plant mtDNA. In another embodiment the introduced nucleic acid will be incorporated (recombined) with the existing endogenous mtDNA sequences resulting in the manipulation of the mtDNA sequences. Either method can be used to restore full functionality to damaged mitochondria.

Another embodiment provides a method for modifying the genome of a non-nuclear organelle, for example a plant mitochondrion or plastid, comprising transfecting the non-nuclear organelle with a polynucleotide encoding an enzyme that specifically cleaves the non-nuclear organelle's genome but does not cleave the polynucleotide. An exemplary enzyme includes, but is not limited to, a nuclease such as NotI. It will be appreciated that any enzyme can be used that selectively cleaves nucleic acids endogenous to the non-nuclear organelle without cleaving heterologous nucleic acids. Heterologous nucleic acids refer to nucleic acids introduced from another organism or from a source other than the mitochondrion or host organism of the mitochondrion. The polynucleotide encoding the enzyme can be delivered alone or in combination with second polynucleotide using the methods described herein. The second polynucleotide can encode a second polypeptide, for example, that functions inside or outside of the non-nuclear organelle. The second polypeptide can function in the nucleus and can be a transcription factor, an enhancer or a suppressor of gene activation or transcription, a subunit of a transcription factor, a DNA binding polypeptide or the like. The second polypeptide can act specifically or non-specifically on one or more specific genes or nucleic acid sequences. The second polypeptide expressed in the non-nuclear organelle can be delivered outside of the non-nuclear organelle. The second polypeptide can comprise at least one PTD and optionally a targeting signal to facilitate translocation of the second polypeptide to a desired intracellular or extracellular location, for example the nucleus, cytoplasm, plasma membrane, etc. It will be appreciated that the second polypeptide can encode a secreted polypeptide, an intracellular polypeptide, a transmembrane polypeptide, or a polypeptide that is at least partially displayed on the exterior surface of a cell membrane. Secreted polypeptides include, but are not limited to, growth factors, cytokines, chemokines, neurotransmitters, insulin, or combinations thereof. Secreted polypeptides can subsequently mature to adopt proper post-translational modifications for proper function. In one embodiment, the secreted polypeptide is a therapeutic molecule produced in plants, for example an antibody.

Alternatively, the polynucleotide encoding the enzyme can be packaged by a polynucleotide-binding polypeptide and combined with a lipid and/or polyamine vector for delivery to the non-nuclear organelle. An exemplary lipid and/or polyamine vector includes, but is not limited to, LIPOFECTAMINE™. The lipid and/or polyamine vector can be modified to display a targeting signal on the exterior to assist in the delivery of the polynucleotide to the non-nuclear organelle.

In some embodiments, the polynucleotide encoding the enzymatic polynucleotide also encodes at least a second polypeptide, for example, a polypeptide that compensates for a mutation in the non-nuclear organelle's genome. The second polypeptide can compensate for a null mutation, deletion, inversion, substitution, or transposition in the non-nuclear organelle's genome. Alternatively, the second polypeptide encodes a functional polypeptide that can be delivered to a location outside of the non-nuclear organelle, for example, the nucleus.

Still another embodiment provides a method form modifying a genome of a non-nuclear organelle comprising transfecting the non-nuclear organelle with a polynucleotide encoding an enzyme that specifically cleaves heterologous nucleic acids but does not cleave the polynucleotide encoding the enzyme or the endogenous nucleic acids of the non-nuclear organelle.

Still another embodiment provides a method for modifying a genome of a non-nuclear organelle comprising contacting a cell with enzymatic polypeptide comprising a PTD and a targeting signal operably linked to the enzymatic polypeptide. The enzymatic polypeptide can be a nuclease or restriction enzyme specific for a restriction site found in the genome of the non-nuclear organelle. Alternatively, the enzymatic polypeptide can cleave nucleic acids at a site found in heterologous nucleic acids and not in nucleic acids endogenous to the non-nuclear organelle. The enzymatic polypeptide can be delivered alone or in combination with a polynucleotide.

Suitable mitochondria localization sequences are known to those skilled in the art (see Table 1) and include the mitochondrial localization signal of subunit VIII of human cytochrome oxidase, the yeast cytochrome c oxidase subunit IV presequence and the amino-terminal leader peptide of the rat ornithine-transcarbamylase. In one embodiment the introduced sequences are expressed on the viral capsid head.

In another embodiment, the plastid genome of C3 plant species is modified to reduce oxygen producing capability and increase C02 fixation ability. This allows low-oxygen conditions necessary for Rubisco to refix CO2 as in C4 plants. Thus carbon dioxide fixation efficiency is increased in C3 plant species.

In one embodiment, plastid and/or mitochondrial genes are modified to introduce the capacity for nitrogen fixation. Nitrogen fixation requires large amounts of energy in the form of ATP and plastids and mitochondria make this as a product of photosynthetic or oxidative energy transduction. For example, the biosynthetic pathway responsible for nitrogen fixation in rhizobia is engineered into the organellar genome to provide the capability to fix atmospheric N2 into organic nitrogen. Since the enzyme nitrogenase is sensitive to O2, an embodiment is provided such that either an oxygen depleting enzyme is introduced, or oxygen production is inhibited. In one embodiment, the polynucleotide encodes at least one protein with anti-microbial properties for expression in the plant. The protein may comprise an antibiotic. Additionally, a recombinant polynucleotide encoding at least one enzyme for converting hard-to-ferment sugars to more easily fermentable sugars for expression in the plant is utilized. In another embodiment, the polynucleotide encodes one or more enzymes capable of modulating the cellulose content of the transgenic plant. In one embodiment, the polynucleotide encodes for at least one protein promoting starch hydrolysis. In another embodiment, the polynucleotide encodes for proteins causing the plant to absorb environmental pollutants such as a metalloid such as arsenic or selenium, a heavy metal such as lead, chromium, cadmium, zinc, copper, or uranium, or a persistent organic pollutant such as DDT or PCBs.

Plastid localization signals are known to those skilled in the art, and any of those signals can be used to target the complex to the target organelle. Localization sequences suitable for use in the present disclosure are described in Emanuelson et al., Predicting Subcellular Localization of Proteins Based on Their N-terminal Amino Acid Sequence. *Journal of Molecular Biology*. 300(4):1005-16, 2000 Jul. 21, and in Cline and Henry, Import and Routing of Nucleus-encoded Chloroplast Proteins. *Annual Review of Cell & Developmental Biology*. 12:1-26, 1996, the disclosures of which are incorporated herein by reference in their entirety. More particularly, proteins and genes that have mitochondria localization signals for targeting linked proteins or nucleic acids to the mitochondria are listed in TABLE 1. Proteins, polypeptides, and nucleic acids encoding polypeptides that have chloroplast localization signals for targeting linked proteins or nucleic acids to the chloroplasts are listed in TABLE 2. In one embodiment the mitochondria or chloroplast localization signal is operably linked to a virus surface protein. It will be appreciated that part or all of the sequences listed in Tables 1 and 2 can be used as organelle targeting signals.

TABLE 1

Localization Signals for Targeting to the Mitochondria.
(verified using Mitochondrial Project MITOP Database --
http://mips.gsf.de/proj/medgen/mitop/)

| MITOP Designation (Accession No.) | SEQ. ID. NO. | Gene Name | Gene Name Full |
|---|---|---|---|
| 106092 (NP633590) | 18 | Etfa | electron transfer flavoprotein alpha chain precursor - mouse |
| 106098 (Q9DCW4) | 19 | Etfb | electron transfer flavoprotein beta chain - mouse |
| 107450 (NP000099) | 20 | Dld | dihydrolipoamide dehydrogenase precursor - human |
| 87979 (NP067274) | 21 | Ak3 | nucleoside-triphosphate--adenylate kinase 3 - mouse |
| 88529 (NP080720) | 22 | Cs | citrate synthase, mitochondrial |
| 891996 (AA031763) | 23 | Cps1 | carbamoyl-phosphate synthetase 1 |
| 97045 (NP032641) | 24 | Mod2 | malic enzyme complex, mitochondrial - mouse |
| 97499 (AAH49802) | 25 | Pcca | propionyl-CoA carboxylase alpha chain precursor - mouse |
| A27883 (NP000273) | 26 | PCCA | propionyl-CoA carboxylase alpha chain precursor |
| A28053 NP031647) | 27 | Cbr2 | carbonyl reductase (NADPH) - mouse |
| A29881 (XP331748) | 28 | mpp-2 | Mitochondrial processing peptidase beta subunit precursor (beta-mpp) (ubiquinol-cytochrome c reductase complexcore protein I) |
| A30605 (NP000008) | 29 | ACADS | acyl-CoA dehydrogenase precursor, short-chain-specific |
| A31998 (WP000117) | 30 | ETFA | electron transfer flavoprotein alpha chain precursor |
| A32422 | 31 | DBT | dihydrolipoamide S-(2-methyl-propanoyl)transferase precursor |
| A32800 (NP002147) | 32 | HSPD1 | heat shock protein 60 precursor |
| A36442 (XP326125) | 33 | mpp-1 | Mitochondrial processing peptidase alpha chain precursor |
| A37033 (NP002216) | 34 | IVD | isovaleryl-CoA dehydrogenase precursor |
| A37157 (NP898871) | 35 | BCKD | 3-methyl-2-oxobutanoate dehydrogenase (lipoamide) E1-beta chain precursor |
| A38234 | 36 | OGDH | oxoglutarate dehydrogenase (lipoamide) precursor |
| A39503 (NP002387) | 37 | ME2 | malate dehydrogenase (NAD+) precursor, mitochondrial |
| A40487 (NP004101) | 38 | FDXR | ferredoxin--NADP+ reductase, long form, precursor |
| A40559 (NP001599) | 39 | ACADL | long-chain-acyl-CoA dehydrogenase (LCAD) |
| A40872 | 40 | ALDH5 | aldehyde dehydrogenase (NAD+) 5 precursor, mitochondrial |
| A41581 (NP005720) | 41 | CYP3 | peptidylprolyl isomerase 3 precursor |
| A42224 (P22572) | 42 | arg-2 | Carbamoyl-phosphate synthase, arginine-specific, small chain precursor (arginine-specific |

TABLE 1-continued

Localization Signals for Targeting to the Mitochondria.
(verified using Mitochondrial Project MITOP Database --
http://mips.gsf.de/proj/medgen/mitop/)

| MITOP Designation (Accession No.) | SEQ. ID. NO. | Gene Name | Gene Name Full |
|---|---|---|---|
| | | | carbamoyl-phosphate synthetase, glutamine chain) (cps-a) |
| A42845 | 43 | BDH | D-beta-hydroxybutyrate dehydrogenase precursor (3-hydroxybutyrate dehydrogenase) (fragment) |
| A45470 (AAP88794) | 44 | HMGC | hydroxymethylglutaryl-CoA lyase |
| A47255 (AAH55030) | 45 | Pcx | pyruvate carboxylase |
| A53020 (AAH53661) | 46 | PCCB | propionyl-CoA carboxylase beta chain precursor |
| A53719 (NP036216) | 47 | GLUDP | glutamate dehydrogenase (NAD(P)+) 2 precursor |
| A55075 (NP032329) | 48 | HspE1 | chaperonin-10 |
| A55680 (NP001600) | 49 | ACADS | short/branched chain acyl-CoA dehydrogenase precursor |
| A55723 (P42126) | 50 | DCI | dodecenoyl-CoA Delta-isomerase precursor, mitochondrial |
| A55724 (NP031408) | 51 | Acadm | Acyl-CoA dehydrogenase, medium-chain specific precursor (MCAD) |
| AA227572 (NM201263) | 52 | WARS2 | tryptophanyl-tRNA synthetase 2 (mitochondrial) - human |
| AB029948 (NP060297) | 53 | SerRS | mitochondrial seryl-tRNA synthetase (cDNA FLJ20450 FIS, CLONE KAT05607) - human |
| ACDL_MOUSE (AAH27412) | 54 | Acadl | Acyl-CoA dehydrogenase, long-chain specific precursor (LCAD) |
| AF047042 (AAC25560) | 55 | CS | citrate synthase, mitochondrial |
| AF097441 (NP006558) | 56 | FARS1 | phenylalanine-tRNA synthetase (FARS1) mRNA, nuclear gene encoding mitochondrial protein - human |
| ATPO_HUMAN (NP001688) | 57 | ATP5O | ATP synthase oligomycin sensitivity conferral protein precursor, mitochondrial |
| AXHU (AAP35327) | 58 | FDX1 | adrenodoxin precursor |
| CCHU (NP061820) | 59 | HCS | cytochrome c |
| CCNC (CAA29050) | 60 | cyc-1 | Cytochrome c |
| CE06620 (NP056155) | 61 | — | Probable leucyl-tRNA synthetase, mitochondrial |
| CE09597 (AAG31658) | 62 | — | Pyruvate dehydrogenase (E2) dihydrolipoamide acetyltransferase |
| CH10_MOUSE (NP032329) | 63 | Hspe1 | 10 KD heat shock protein, mitochondrial (hsp10) (10K chaperonin) mouse |
| CH60_CAEEL (NP497429) | 64 | hsp60 | Chaperonin homolog hsp60 precursor (heat shock protein 60) (hsp-60) |
| DEHUE2 (NP000681) | 65 | ALDH2 | aldehyde dehydrogenase (NAD+) 2 precursor, mitochondrial |
| DEHUE (NP005262) | 66 | GLUD1 | glutamate dehydrogenase (NAD(P)+) precursor |
| DEHULP (NP000099) | 67 | DLD | dihydrolipoamide dehydrogenase precursor |
| DEHUPA (NP000275) | 68 | PDHA1 | pyruvate dehydrogenase (lipoamide) alpha chain precursor |
| DEHUPB (AAH00439) | 69 | PDHB | pyruvate dehydrogenase (lipoamide) beta chain precursor |
| DEHUPT (NP005381) | 70 | PDHA2 | pyruvate dehydrogenase (lipoamide) alpha chain precursor, testis-specific (E1) |
| DEHUXA (NP000700) | 71 | BCKDH | 3-methyl-2-oxobutanoate dehydrogenase (lipoamide) alpha chain precursor |
| DEMSMM (P08249) | 72 | Mor1 | malate dehydrogenase precursor, mitochondrial |
| DSHUN | 73 | SOD2 | superoxide dismutase (Mn) precursor |
| ECHM_HUMAN | 74 | ECHS1 | enoyl-CoA hydratase, mitochondrial |

TABLE 1-continued

Localization Signals for Targeting to the Mitochondria.
(verified using Mitochondrial Project MITOP Database --
http://mips.gsf.de/proj/medgen/mitop/)

| MITOP Designation (Accession No.) | SEQ. ID. NO. | Gene Name | Gene Name Full |
|---|---|---|---|
| (NP004083) | | | (short chain enoyl-CoA hydratase (SCEH)) |
| GABT_HUMAN (JC4022) | 75 | ABAT | 4-aminobutyrate aminotransferase, mitochondrial precursor (gamma-amino-N-butyrate-transaminase) (GABA transaminase) |
| GCDH_HUMAN (AAP35352) | 76 | GCDH | glutaryl-CoA dehydrogenase precursor (GCD) - human |
| GCDH_MOUSE (NP032123) | 77 | Gcdh | Glutaryl-CoA dehydrogenase precursor (GCD) - mouse |
| HCD1_CAEEL (NP499075) | 78 | — | Probable 3-hydroxyacyl-CoA dehydrogenase F54C8.1 |
| HCD2_CAEEL (NP509584) | 79 | — | Probable 3-hydroxyacyl-CoA dehydrogenase B0272.3 |
| HHMS60 (NP034607) | 80 | Hsp60 | heat shock protein 60 precursor |
| HMGL_MOUSE (AAB27965) | 81 | Hmgcl | hydroxymethylglutaryl-CoA lyase precursor (HG-CoA lyase) (HL) (3-hydroxy-3-methylglutarate-CoA lyase) |
| I48884 (AAC52130) | 82 | — | 2-oxoglutarate dehydrogenase E1 component (fragment) |
| I48966 (AAH05476) | 83 | Aldh2 | aldehyde dehydrogenase (NAD+) 2 precursor, mitochondrial |
| I49605 | 84 | Acads | Acyl-CoA dehydrogenase, short-chain specific precursor (SCAD) (butyryl-CoA dehydrogenase) |
| I52240 (NP000007) | 85 | ACAD | acyl-CoA dehydrogenase precurser, medium-chain-specific |
| I55465 (AAH39158) | 86 | PDK1 | pyruvate dehydrogenase kinase isoform 1 - human |
| I57023 (DSHUN) | 87 | Sod2 | superoxide dismutase (Mn) precursor |
| I70159 (AAC42010) | 88 | PDK2 | pyruvate dehydrogenase kinase isoform 2 - human |
| I70160 (NP005382) | 89 | PDK3 | pyruvate dehydrogenase kinase isoform 3 - human |
| JC2108 (AAA56664) | 90 | HADH | long-chain-fatty-acid beta-oxidation multienzyme complex alpha chain precursor, mitochondrial |
| JC2109 (NP000174) | 91 | HADH | long-chain-fatty-acid beta-oxidation multienzyme complex beta chain precursor, mitochondrial |
| JC2460 (AAH11617) | 92 | PC | pyruvate carboxylase precursor |
| JC4879 (NP005318) | 93 | SCHAD | 3-hydroxyacyl-CoA dehydrogenase, short chain-specific, precursor |
| KIHUA3 (AAH16180) | 94 | AK3 | nucleoside-triphosphate--adenylate kinase 3 |
| M2GD_HUMAN (AAF21941) | 95 | DMGD | dimethylglycine dehydrogenase, mitochondrial precursor (ME2GLYDH) - human |
| MDHM_HUMA (AAH01917) | 96 | MDH2 | malate dehydrogenase mitochondrial precursor (fragment) |
| O75439 | 97 | PMPC | mitochondrial processing peptidase beta subunit precursor (beta-MPP) (P-52) |
| ODO1_MOUSE (AAC52130) | 98 | Ogdh | 2-oxoglutarate dehydrogenase E1 component (alpha-ketoglutarate dehydrogenase) (fragment) |
| ODPA_CAEEL (NP495693) | 99 | — | Probable pyruvate dehydrogenase E1 component, alpha subunit precursor (PDHE1-a) |
| OWHU (NP000522) | 100 | OTC | ornithine carbamoyltransferase precursor |
| OWMS (CAA30121) | 101 | Otc | ornithine carbamoyltransferase precursor |
| P21549 (NP000021) | 102 | AGXT | alanine--glyoxylate aminotransferase |
| PUT2_HUMAN (NP733844) | 103 | ALDH4 | Delta-1-pyrroline-5-carboxylate dehydrogenase precursor (P5C dehydrogenase) |

TABLE 1-continued

Localization Signals for Targeting to the Mitochondria.
(verified using Mitochondrial Project MITOP Database --
http://mips.gsf.de/proj/medgen/mitop/)

| MITOP Designation (Accession No.) | SEQ. ID. NO. | Gene Name | Gene Name Full |
|---|---|---|---|
| Q0140 (NP009320) | 104 | VAR1 | VAR1 - mitochondrial ribosomal protein |
| Q10713 (NP055975) | 105 | KIAA0123 | mitochondrial processing peptidase alpha subunit precursor (alpha-MPP) (P-55) (HA1523) |
| Q16654 (NP002603) | 106 | PDK4 | pyruvate dehydrogenase kinase isoform 4 - human |
| ROHU (CAA42060) | 107 | TST | thiosulfate sulfurtransferase |
| S01174 (NP034455) | 108 | Got2 | aspartate transaminase precursor, mitochondrial |
| S08680 (NP032676) | 109 | Mut | methylmalonyl-CoA mutase alpha chain precursor |
| S13025 (CAA39695) | 110 | nuo-40 | NADH dehydrogenase (ubiquinone) 40K chain |
| S13048 (PI9974) | 111 | cyt | cytochrome c |
| S16239 (AAH57347) | 112 | Glud | glutamate dehydrogenase (NAD(P)+) precursor |
| S23506 (NP032836) | 113 | Pdha1 | pyruvate dehydrogenase (lipoamide) |
| S25665 (CAA32052) | 114 | DLAT_h | dihydrolipoamide S-acetyltransferase heart - human (fragment) |
| S26984 (P33540) | 115 | — | probable DNA-directed RNA polymerase - mitochondrion plasmid maranhar (SGC3) |
| S32482 (NP001976) | 116 | ETFB | electron transfer flavoprotein beta chain |
| S38770 (P42125) | 117 | Dci | 3,2-trans-enoyl-CoA isomerase, mitochondrial precursor (dodecenoyl-CoA delta-isomerase) |
| S39807 | 118 | Bckdhb | 3-methyl-2-oxobutanoate dehydrogenase (lipoamide) beta chain |
| S40622 (NP000246) | 119 | MUT | methylmalonyl-CoA mutase precursror (MCM) |
| S41006 (CAE65137) | 120 | — | hypothetical protein t05g5.6 |
| S41563 | 121 | cit-1 | citrate (si)-synthase, mitochondrial |
| S42366 | 122 | PRSS15 | Lon proteinase homolog |
| S42370 (NP499264) | 123 | — | citrate synthase homolog |
| S47532 (NP002148) | 124 | HSPE1 | heat shock protein 10 |
| S53351 (NP006671) | 125 | ME2.1 | malate dehydrogenase (oxaloacetate-decarboxylating) (NADP+) precursor, mitochondrial |
| S60028 (NP032023) | 126 | Fdxr | ferredoxin--NADP+ reductase precursor |
| S65760 (NP034152) | 127 | Dbt | dihydrolipoamide transacylase precursor |
| S71881 (NP031559) | 128 | Bckdha | branched chain alpha-ketoacid dehydrogenase chain E1-alpha precursor |
| SCOT_HUMA (NP000427) | 129 | OXCT | Succinyl-CoA: 3-ketoacid-coenzyme A transferase precursor (succinyl CoA: 3-oxoacid CoA-transferase) (OXCT) |
| SODM_CAEEL (NP492290) | 130 | sod-2 | Superoxide dismutase precursor (Mn) |
| SODN_CAEEL (NP510764) | 131 | sod-3 | Superoxide dismutase precursor (Mn) |
| SYHUAE | 132 | ALAS2 | 5-aminolevulinate synthase 2 |
| SYHUAL (NP000679) | 133 | ALAS1 | 5-aminolevulinate synthase 1 precursor |
| SYLM_HUMAN (NP056155) | 134 | KIAA0028 | Probable leucyl-tRNA synthetase, mitochondrial precursor (Leucine--tRNA ligase) (Leurs) (KIAA0028) |
| SYMSAL | 135 | Alas2 | 5-aminolevulinate synthase mitochondrial precursor (erythroid-specific) (ALAS-E) |
| SYNCLM (XP323115) | 136 | leu-5 | leucine--tRNA ligase precursor, mitochondrial |

TABLE 1-continued

Localization Signals for Targeting to the Mitochondria.
(verified using Mitochondrial Project MITOP Database --
http://mips.gsf.de/proj/medgen/mitop/)

| MITOP Designation (Accession No.) | SEQ. ID. NO. | Gene Name | Gene Name Full |
|---|---|---|---|
| SYNCYT | 137 | cyt-18 | tyrosine--tRNA ligase precursor, mitochondrial |
| SYWM_CAEEL (T15761) | 138 | — | Probable tryptophanyl-tRNA synthetase, mitochondrial (tryptophan--tRNA ligase) (TRPRS) |
| THTR_MOUSE (NP033463) | 139 | Tst | thiosulfate sulfortransferase |
| U80034 (NP005923) | 140 | MIPEP | mitochondrial intermediate peptidase |
| U82328 (NP003468) | 141 | PDX1 | pyruvate dehydrogenase complex protein X subunit precursor |
| XNHUDM (NP002071) | 142 | GOT2 | aspartate transaminase precursor, mitochondrial |
| XNHUO (NP000265) | 143 | OAT | ornithine--oxo-acid transaminase precursor |
| XNHUSP (NP000021) | 144 | AGXT | serine--pyruvate aminotransferase (SPT) (alanine--glyoxylate aminotransferase) (AGT) |
| XNMSO (AAH08119) | 145 | Oat | ornithine--oxo-acid transaminase precursor |
| XXHU | 146 | DLAT | dihydrolipoamide S-acetyltransferase precursor (fragment) |
| YAL044c (P39726) | 147 | GCV3 | GCV3 - glycine decarboxylase, subunit H |
| YBL022c (NP009531) | 148 | PIM1 | PIM1 - ATP-dependent protease, mitochondrial |
| YBL038w (NP009515) | 149 | MRPL16 | MRPL16 - ribosomal protein of the large subunit, mitochondrial |
| YBL080c (NP009473) | 150 | PET112 | PET112 - required to maintain rho+ mitochondrial DNA |
| YBL090w (NP009463) | 151 | MRP21 | MRP21 - Mitochondrial ribosomal protein |
| YBR120c (NP009678) | 152 | CBP6 | CBP6 - apo-cytochrome B pre-mRNA processing protein |
| YBR122c (CAA55624) | 153 | MRPL36 | MRPL36 - ribosomal protein YmL36 precursor, mitochondrial |
| YBR146w (NP009704) | 154 | MRPS9 | MRPS9 - ribosomal protein S9 precursor, mitochondrial |
| YBR221c (NP009780) | 155 | PDB1 | PDB1 - pyruvate dehydrogenase (lipoamide) beta chain precursor |
| YBR227c (NP009786) | 156 | MCX1 | MCX1 - ClpX homologue in mitochondria |
| YBR251w (NP009810) | 157 | MRPS5 | MRPS5 - ribosomal protein S5, mitochondrial |
| YBR268w (NP009827) | 158 | MRPL37 | MRPL37 - ribosomal protein YmL37, mitochondrial |
| YBR282w (NP009841) | 159 | MRPL27 | MRPL27 - ribosomal protein YmL27 precursor, mitochondrial |
| YCR003w (NP009929) | 160 | MRPL32 | MRPL32 - ribosomal protein YmL32, mitochondrial |
| YCR024c (NP009953) | 161 | — | asn-tRNA synthetase, mitochondrial |
| YCR028c-a (NP009958) | 162 | RIM1 | RIM1 - ssDNA-binding protein, mitochondrial |
| YCR046c (NP009975) | 163 | IMG1 | IMG1 - ribosomal protein, mitochondrial |
| YDL202w (NP010079) | 164 | MRPL11 | MRPL11 - ribosomal protein of the large subunit, mitochondrial |
| YDR148c (NP010432) | 165 | KGD2 | KGD2 - 2-oxoglutarate dehydrogenase complex E2 component |
| YDR194c (NP010480) | 166 | MSS116 | MSS116 - RNA helicase of the DEAD box family, mitochondrial |
| YDR462w (NP010750) | 167 | MRPL28 | MRPL28 - ribosomal protein of the large subunit (YmL28), mitochondrial |
| YFL018c (NP116635) | 168 | LPD1 | LPD1 - dihydrolipoamide dehydrogenase precursor |
| YGR244c (NP011760) | 169 | LSC2 | succinate-CoA ligase beta subunit |
| YHR008c (NP011872) | 170 | SOD2 | SOD2 - superoxide dismutase (Mn) precursor, mitochondrial |
| YIL070c (NP012194) | 171 | MAM33 | MAM33 - mitochondrial acidic matrix protein |

TABLE 1-continued

Localization Signals for Targeting to the Mitochondria.
(verified using Mitochondrial Project MITOP Database --
http://mips.gsf.de/proj/medgen/mitop/)

| MITOP Designation (Accession No.) | SEQ. ID. NO. | Gene Name | Gene Name Full |
|---|---|---|---|
| YJL096w (CAA89390) | 172 | MRPL49 | MRPL49 - ribosomal protein YmL49, mitochondrial |
| YJR113c (NP012647) | 173 | RSM7 | RSM7 - similarity to bacterial, chloroplast and mitochondrial ribosomal protein S7 |
| YKL040c (NP012884) | 174 | NFU1 | NFU1 - iron homeostasis |
| YLL027w (NP013073) | 175 | ISA1 | ISA1 - mitochondrial protein required for normal iron metabolism |
| YLR059c (NP013160) | 176 | REX2 | REX2 - putative 3'-5' exonuclease |
| YML110c (NP013597) | 177 | COQ5 | COQ5 - ubiquinone biosynthesis, methyltransferase |
| YMR062c (NP013778) | 178 | ECM40 | ECM40 - acetylornithine acetyltransferase |
| YMR072w (NP013788) | 179 | ABF2 | ABF2 - high mobility group protein |
| YOL095c (NP014546) | 180 | HMI1 | HMI1 - mitochondrial DNA helicase |
| YOR040w (NP014683) | 181 | GLO4 | GLO4 - glyoxalase II (hydroxyacylglutathione hydrolase) |
| YOR142w (NP014785) | 182 | LSC1 | LSC1 - succinate-CoA ligase alpha subunit |
| YPL118w (NP015207) | 183 | MRP51 | MRP51 - strong similarity to *S. kluyveri* hypothetical protein |
| YPL135w (NP015190) | 184 | ISU1 | ISU1 - protein with similarity to iron-sulfur cluster nitrogen fixation proteins |
| YPL252c (NP015071) | 185 | YAH1 | YAH1 - similarity to adrenodoxin and ferrodoxin |
| YPL262w (NP015061) | 186 | FUM1 | FUM1 - fumarate hydratase |
| YPR047w (CAA89167) | 187 | MSF1 | MSF1 - phenylalanine--tRNA ligase alpha chain, mitochondrial |
| YPR067w (NP015392) | 188 | ISA2 | ISA2 - mitochondrial protein required for iron metabolism |

TABLE 2

Localization Signals for Targeting to the Chloroplast:

| Designation (Accession No.) | SEQ. ID NO. | Description |
|---|---|---|
| CA782533 | 189 | Transit peptide domain of the apicoblast ribosomal protein S9 |
| P27456 (CAA62482) | 190 | Pea glutathione reductase (GR) signal peptide |
| BAB91333 | 191 | NH$_2$-terminus of Cr-RSH encoding a putative guanosine 3',5'-bispyrophosphate (ppGpp) synthase-degradase |
| CAB42546 | 192 | 14-3-3 proteins |
| AAC64139 | 193 | Chloroplast signal recognition particle including cpSRP54, cpSRP43 subunits or a fragment thereof |
| AAC64109 | 194 | |
| AAD01509 | 195 | |
| PWSPG, | 196 | Chloroplast transit peptides |
| FESP1, | 197 | |
| P00221, | 198 | |
| P05435, | 199 | |
| BAA37170, | 200 | |
| BAA37171, | 201 | |
| AAA81472 | 202 | |
| X52428 (CAA36675) | 203 | AtOEP7, in particular the transmembrane domain (TMD) and its C-terminal neighboring seven-amino acid region (see Lee Y J, Plant Cell 2001 Oct; 13(10): 2175-90) |
| CA757092, | 204 | THI1 N-terminal chloroplastic transit peptide, in particular 4 to 27 residues |
| CA755666 | 205 | |

The identification of the specific sequences necessary for translocation of a linked protein into a chloroplast or mitochondria can be determined using predictive software known to those skilled in the art, including the tools located at http://www.mips.biochem.mpg.de/cgi-bin/proj/medgen/mitofilter.

5. Transfection of Plant Nuclei

Another embodiment provides methods and compositions for the transfection of plants, for example the delivery of a polynucleotide to the plant nucleus.

One embodiment of the present disclosure discloses transfecting a plant cell with the transfection complex comprises a recombinant polypeptide having a protein transduction domain and a nuclear localization signal in combination with a polynucleotide. In one embodiment, the polynucleotide encodes at least one protein with anti-microbial properties for expression in the plant. The protein may comprise an antibiotic. Additionally, a recombinant polynucleotide encoding at least one enzyme for converting hard-to-ferment sugars to more easily fermentable sugars for expression in the plant is utilized. In another embodiment, the polynucleotide encodes one or more enzymes capable of modulating the cellulose content of the transgenic plant. In one embodiment, the polynucleotide encodes for at least one protein promoting starch hydrolysis. In another embodiment, the polynucleotide encodes for proteins causing the plant to absorb environmental pollutants such as a metalloid such as arsenic or selenium, a heavy metal such as lead, chromium, cadmium, zinc, copper, or uranium, or a persistent organic pollutant such as DDT or PCBs.

6. Exemplary Cells and Cell Lines

In another embodiment, the transfection complex comprises a recombinant polypeptide having a protein transduction domain and an organelle localization signal in combination with a polynucleotide. The complex can be introduced into organelles of cells from a cell line. The cell line can be a transformed cell line that can be maintained indefinitely in cell culture, or the cell line can be a primary cell culture. Exemplary cell lines are those available from American Type Culture Collection including plant cell lines which are incorporated herein by reference. The nucleic acid can be replicated and transcribed within the nucleus of a cell of the transfected cell line. The targeting signal can be enzymatically cleaved if necessary such that the complex is free to remain in the target organelle.

Any eukaryotic cell can be transfected to produce organelles that express a specific nucleic acid, for example a metabolic gene, including primary cells as well as established cell lines. Suitable types of cells include but are not limited to undifferentiated or partially differentiated cells including stem cells, totipotent cells, pluripotent cells, embryonic stem cells, inner mass cells, adult stem cells, and cells derived from ectoderm, mesoderm, or endoderm. Suitable plant cells can be selected from monocots and dicots, and include corn, soybeans, legumes, grasses, and grains such as rice and wheat.

If the organelle to be targeted is a plastid, then the host cell can be selected from known eukaryotic photosynthetic cells. If the organelle to be transfected is the mitochondrion, than any eukaryotic cell can be used, including mammalian cells, for example human cells. The cells are transfected to either transiently or stably express the exogenous nucleic acid. In one embodiment a DNA construct encoding a reporter gene is integrated into the mitochondrial genome of a cell to produce a stable transgenic cell line that comprises organelles that express the desired reporter gene. In one embodiment, the polynucleotide encodes at least one protein with anti-microbial properties for expression in the plant. The protein may comprise an antibiotic.

In another embodiment, siRNA or antisense polynucleotides (including siRNA or antisense polynucleotides directed to mtDNA related proteins) can be transfected into an organelle using the compositions described herein.

7. Transgenic Organisms

Plants

The techniques described in the present disclosure can also be used to generated transgenic non-human animals. In particular, zygote microinjection, nuclear transfer, blastomere electrofusion and blastocyst injection of embryonic stem (ES) cell cybrids have each provided feasible strategies for creating hetero- and homoplasmic mice containing mtDNA from transfected cell lines (i.e. cells that containing transfected mitochondria). In one embodiment an embryonic stem (ES) cell is transfected and injected into the blastocyst of a mammalian embryo as a means of generating chimeric mice. In another embodiment, embryonic stem (ES) cell cybrids (from transfected cells and ES cell rhos, or from two separately transfected cells) are first prepared, followed by blastocyst injection into embryos. The use of cells carrying specific mtDNA of interest allows the creation of transmitochondrial mice that are heteroplasmic or even homoplasmic for the transfected DNA. In theory, this technique offers the prospect of transferring any mutant mtDNA that can be obtained from cultured transfected cells into a whole organism model. For example, this disclosed methods and compositions could be used to create mouse models of human mtDNA disease.

Using the disclosed compositions and methods for mtDNA transfection will allow investigations into questions such as the effect of varying proportions of the 5000 bp "common deletion", which accumulates with aging, polymorphisms found in diabetes and neurodegenerative diseases, and dynamics of mtDNA complementation. There are also potential therapeutic uses of this approach. Targeted introduction of the normal mitochondrial genome offers treatment for both classic mtDNA-based diseases and diseases of aging such as neurodegenerative brain conditions and adult-onset diabetes, which have been associated with mtDNA-based mitochondrial dysfunction.

Nan-Human Organisms

Another embodiment of the disclosure provides transfected non-human organisms and methods making and using them. Single or multicellular non-human organisms, preferably non-human mammals, more preferably mice, can be transfected with the compositions described herein by administering the compositions of the present disclosure to the non-human organism. In one embodiment, the polynucleotide remains episomal and does not stably integrate into the genome of the host organism. In another embodiment, the polynucleotide prevents the expression of a gene of interest. Thus, the expression of the polynucleotide in the host can be controlled by the amount of polynucleotide administered to the host.

The disclosed transfected non-human organisms have several advantages over traditional transgenic organisms. For example, the transfected organism disclosed herein can be produced in less time that traditional transgenic organisms without sexual reproduction. Moreover, the expression of the polynucleotide of interest in the host can be directly regulated by the amount of polynucleotide of interest administered to the host. Dosage controlled expression of a polynucleotide of interest can be correlated to observed phenotypes and changes in the transfected animal. Additionally, inducible expression and/or replication control elements can be included in the polynucleotide of interest to provide inducible and dosage dependent expression and/or replication. Suitable inducible expression and/or replication control elements are known in the art.

8. Phytopathology

Embodiments of the present disclosure provide compositions and methods applicable for gene therapy protocols for plants. Organelle dysfunction can also be treated or reduced using the disclosed compositions and methods. In particular, problems with mitochondria or plastids can result in disease. Additionally, treating or modifying mitochondria or plastid genomes may provide resistance to plant pathogens and environmental conditions. Plant diseases are caused by pathogens and environmental conditions. Organisms that cause infectious disease include fungi, oomycetes, bacteria, viruses, viroids, virus-like organisms, phytoplasmas, protozoa, nematodes and parasitic plants. Included are insects, mites, vertebrate or other pests that affect plant health by consumption of plant tissues. Environmental conditions leading to plant pathology can include drought, frost damage and breakage by snow and hail, flooding and poor drainage, nutrient deficiency, salt deposition and other soluble mineral excesses, wind, wildfire, soil compaction, pollution of air and/or soil and herbicide. Plants or plant cells can be transfected with polynucleotides that increase resistance to stress. The polynucleotides can encode polypeptides that increase resistance to stress. Exemplary polypeptides capable of providing resistance to stress include but are not limited to transcription factors responsible for generating plant stress response genes such as CaKR1, AtNDPK2 and OsNAC6. Additionally, exemplary genes involved in plant resistance to stress are known in the art and can be found under the Generation Challenge Programme (GCP). Thermostable proteins from the archaebacteria, including thermostable peroxidases are further examples.

In one embodiment the plant transfected using the disclosed compositions so that the plant can produce an antibiotic, for example an antibiotic peptide or protein with antibiotic capability (as in a antibiotic resistance gene) or to express a protein/pathway that would produce a metabolite with antibiotic function (as in penicillin).

In another embodiment the polynucleotide used to transfect the plant cell expresses at least one polypeptide capable of increasing the efficiency of photosynthesis compared to a control. Exemplary polypeptides capable of increasing the efficiency of photosynthesis include but are not limited to, ribulose-1,5-bisphosphate carboxylase/oxygenase (Rubisco) or modified forms thereof, a glycolate catabolic pathway from E. coil including glycolate dehydrogenase, glyoxylate carboligase, and tartronic semialdehyde reductase.

Still another embodiment provides transfecting the plant or plant cell with a polynucleotide that expresses at least one polypeptide capable of increasing the efficiency of oxidative phosphorylation compared to a control. Exemplary polypeptides capable of increasing the efficiency of oxidative phosphorylation include but are not limited to plant uncoupling proteins, alternative oxidase, antioxidant proteins such as superoxide dismutase and ascorbate peroxidase and alternative mtDNA genes such as yeast Ndi1. In another embodiment, plants are made to express genes, such as Guanidinoacetate N-methyltransferase, Glycine amidinotransferase and creatine kinase, involved in the formation of creatine and phospho-creatine which act as energy reservoirs.

The polynucleotide can also express at least one polypeptide capable of converting hard-to-ferment sugars, such as dextrins, to more easily fermentable sugars, such as glucose and maltose. Exemplary polypeptides capable of converting hard-to-ferment sugars to more easily fermentable sugars include but are not limited to alpha and beta-amylase, pectinase, glucoamylase, pullulanase and other enzymes utilized in the art for saccharification.

In another embodiment the polynucleotide expresses at least one polypeptide capable of modulating the cellulose content of a plant. Exemplary polypeptides capable of modulating the cellulose content of a plant include but are not limited to cellulases, glucanases, celludextrinase and avicelase found in fungi, bacteria and protozoans, among others. These include endo-cellulases, exo-cellulase, cellobiase or beta-glucosidase, oxidative cellulases such as cellobiose dehydrogenase and cellulose phosphorylases. Cellulases are well known in the art and are used in various processes in the textile industry, laundry detergents, pulp and paper industry and, more recently, biofuels. Furthermore, thermostable cellulases such as, Cel6A and Cel6B, from archaebacteria such as Thermobifida fusca are further examples.

In still another embodiment the polynucleotide expresses at least one polypeptide capable of promoting starch hydrolysis. Exemplary polypeptides capable of promoting starch hydrolysis include but are not limited to glycoside hydrolase enzymes also known as the family of amylase enzymes such as alpha, beta and gamma amylase.

In still another embodiment the polynucleotide expresses at least one polypeptide capable of accumulating useful oils, such as stearic acid, oleic acid, linoleic acid, among others, include but are not limited to 18:0-delta9-ACP desaturase, 18:1-delta12-desaturase, 16:0-delta4-ACP desaturase, among others. Exemplary polypeptides capable of accumulating rubbers in plants include but are not limited to hydroxymethylglutaryl-CoA reductase, FPP synthase, mevalonate kinase, phosphomevalonate kinase, diphosphomevalonate decarboxylase, IPP isomerase and small rubber particle protein among others. Exemplary polypeptides capable of producing novel biomaterials such as polyhydroxyalkanoates (PHA), polyesters and silk proteins, include but are not limited to 3-ketothiolase, acetoacetyl-CoA reductase, PHB synthase, dragline and flageliform spider silk, among others.

In one embodiment the polynucleotide expresses at least one polypeptide with pharmaceutical or therapeutic utility. Exemplary polypeptides expressed in plants with pharmaceutical, neutraceutical or therapeutic utility include but are not limited to IgG, acetylcholinesterase, alpha-interferon, human alpha-1-antitrypsin, secretory IgA, interferon gamma, Cholera toxin B (CTB) antigen, Anthrax protective antigen, Plague vaccine antigen, Canine parvovirus (CPV) VP2 antigen, Insulin like growth factor (IGF-1), Human serum albumin (HSA), Antimicrobial peptide, and monoclonal antibodies such as Guy's 13.

Thus, embodiments of the present disclosure are directed to treating a plant disease by introducing a vector into the host cell wherein the vector specifically binds to the organelle and wherein the vector comprises a nucleic acid encoding at least one protein or peptide providing resistance to the phytopathology. The present disclosure encompasses manipulating, augmenting or replacing portions of the organellar genomes to treat plant diseases.

9. Administration

The compositions provided herein may be administered in a physiologically acceptable carrier to a host. Preferred methods of administration include systemic or direct administration to a cell. The compositions can be administered to a cell or plant, as is generally known in the art for gene delivery applications. In gene delivery applications, the compositions are introduced into cells in order to transfect an organelle. The modified complex compositions can be combined in admixture with an acceptable carrier vehicle. Therapeutic formulations are prepared for storage by mixing the active ingredient having the desired degree of purity with optional physiologically acceptable carriers, excipients or stabilizers (Remington's Pharmaceutical Sciences 16th edition, Osol, A. Ed. (1980)), in the form of lyophilized formulations or aqueous solutions. Acceptable carriers, excipients or stabilizers are nontoxic to recipients at the dosages and concentrations employed, and include buffers such as phosphate, citrate and other organic acids; antioxidants including ascorbic acid; low molecular weight (less than about 10 residues) polypeptides; proteins, such as serum albumin, gelatin or immunoglobulins; hydrophilic polymers such as polyvinylpyrrolidone, amino acids such as glycine, glutamine, asparagine, arginine or lysine; monosaccharides, disaccharides and other carbohydrates including glucose, mannose, or dextrins; chelating agents such as EDTA; sugar alcohols such as mannitol or sorbitol; salt-forming counterions such as sodium; and/or nonionic surfactants such as Tween®, Pluronics® or PEG.

The compositions of the present disclosure can be administered parenterally. As used herein, "parenteral administration" is characterized by administering a pharmaceutical composition through a physical breach of plant tissue. Parenteral administration includes administering by injection, through a surgical incision, or through a tissue-penetrating wound, and the like.

Parenteral formulations can include the active ingredient combined with a pharmaceutically acceptable carrier, such as sterile water or sterile isotonic saline. Such formulations may be prepared, packaged, or sold in a form suitable for bolus administration or for continuous administration. Injectable formulations may be prepared, packaged, or sold in unit dosage form, such as in ampules or in multi-dose containers containing a preservative. Parenteral administration formulations include suspensions, solutions, emulsions in oily or aqueous vehicles, pastes, reconsitutable dry (i.e. powder or granular) formulations, and implantable sustained-release or biodegradable formulations. Such formulations may also include one or more additional ingredients including suspending, stabilizing, or dispersing agents. Parenteral formulations may be prepared, packaged, or sold in the form of a sterile injectable aqueous or oily suspension or solution. Parenteral formulations may also include dispersing agents, wetting agents, or suspending agents described herein. Methods for preparing these types of formulations are known. Sterile injectable formulations may be prepared using non-toxic parenterally-acceptable diluents or solvents, such as water, 1,3-butane diol, Ringer's solution, isotonic sodium chloride solution, and fixed oils such as synthetic monoglycerides or diglycerides. Other parentally-administrable formulations include microcrystalline forms, liposomal preparations, and biodegradable polymer systems. Compositions for sustained release or implantation may include pharmaceutically acceptable polymeric or hydrophobic materials such as emulsions, ion exchange resins, sparingly soluble polymers, and sparingly soluble salts.

As used herein, "additional ingredients" include one or more of the following: excipients, surface active agents, dispersing agents, inert diluents, granulating agents, disintegrating agents, binding agents, lubricating agents, sweetening agents, flavoring agents, coloring agents, preservatives, physiologically degradable compositions (e.g., gelatin), aqueous vehicles, aqueous solvents, oily vehicles and oily solvents, suspending agents, dispersing agents, wetting agents, emulsifying agents, demulcents, buffers, salts, thickening agents, fillers, emulsifying agents, antioxidants, antibiotics, antifungal agents, stabilizing agents, and pharmaceutically acceptable polymeric or hydrophobic materials. Other "additional ingredients" which may be included in the pharmaceutical compositions are known. Suitable additional ingredients are described in Remington's Pharmaceutical Sciences, Mack Publishing Co., Genaro, ed., Easton, Pa. (1985).

Dosages and desired concentrations modified vectors disclosed herein in gene delivery compositions of the present disclosure may vary depending on the particular use envisioned. The determination of the appropriate dosage or route of administration is well within the skill the art.

EXAMPLES

Example 1

Recombinant Constructs (SEQ. ID. NO.: 218)
PTD-MLS-TFAM peptide Length: 259

MARRRRRRRR RRRMAFLRSM WGVLSALGRS GAELCTGCGS

RLRSPFSFVY LPRWFSSVLA SCPKKPVSSY LRFSKEQLPI

FKAQNPDAKT TELIRRIAQR WRELPDSKKK IYQDAYRAEW

QVYKEEISRF KEQLTPSQIM SLEKEIMDKHLKRKAMTKKK

ELTLLGKPKR PRSAYNVYVA ERFQEAKGDS

PQEKLKTVKENWKNLSDSEK ELYIQHAKED ETRYHNEMKS

WEEQMIEVGR KDLLRRTIKKQRKYGAEEC*

The 11 amino acid protein transduction domain (PTD) consisting of 11 arginines was cloned upstream and in frame of the chloroplast localization signal (CLS) of the chloroplast targeted chaperonin, Cpn21, of *Arabidopsis thaliana* (gi: 12643263). The PTD-CLS was cloned in frame and upstream of the cDNA of TFAM and cloned into a bacterial expression vector. The recombinant protein was expressed in bacteria and isolated. Purified protein was concentrated and protein concentration was assessed with the Bradford Assay (Biorad). Purified protein was analyzed with SDS-Page to verify purity.

Example 2

Construct Sequence Data

PTD-CLS-TFAM Sequence (PTD underlined; Chloroplast Localization Signal from chloroplast targeted chaperonin, Cpn21, of *A. thaliana* double underlined; TFAM dash underline) Peptide Sequence Length: 291 aa (SEQ ID NO: 208)
MRRRRRRRRRRGEGDIMGEWGNEIFGAIAGFLGGEMAATQLTASPVT

MSARSLASLDGLRASSVKFSSLKPGTLRQSQFRRLVVKASSVLASCPKKP

VSSYLRESKEQLPIEKAQNPDAKTTELIRRIAQRWRELPDSKKKIYQDAY

RAEWQVYKEEISRFKEQLTPSQIMSLEKEIMDKHLKRKAMTKKKELTLL

GKPKRPRSAYNVYVAERFQEAKGDSPQEKLKTVKENWKNLSDSEKELY

IQHAKEDETRYHNEMKSWEEQMIEVGRKDLLRRTIKKQRKYGAEEC*

PTD-MLS-TFAM Sequence (PTD underlined; Plant Mitochondrial Localization Signal from *A. thaliana* malate dehydrogenase double underlined; TFAM dash underline) Peptide Sequence Length: 262 aa (SEQ ID NO: 209)

MRRRRRRRRRRRGEGDIMGEWGNEIFGAIAGFLGGEMFRSMLV
RSSASAKQAVIRRSFSSVLASCPKKPVSSYLRESKEQLPIFKAQNPDAKTT
ELIRRIAQRWRELPDSKKKIYQDAYRAEWQVYKEEISRFKEQLTPSQIMS
LEKEIMDKHLKRKAMTKKKELTLLGKPKRPRSAYNVYVAERFQEAKGD
SPQEKLKTVKENWKNLSDSEKELYIQHAKEDETRYHNFMKSWEEQMIE
VGRKDLLRRTIKKQRKYGAEEC

PTD-NLS-TFAM Sequence (PTD underlined; Plant Nuclear Localization Signal from Maize Opaque2 transcription factor double underlined; TFAM dash underline) Peptide Sequence Length: 271 aa (SEQ ID NO: 210)

MRRRRRRRRRRRGEGDIMGEWGNEIFGAIAGFLGGEMPTEERVR
KRKESNRESARRSRYRKAAHLKCSSVLASCPKKPVSSYLRESKEQLPIFK
AQNPDAKTTELIRRIAQWRELPDSKKKIYQDAYRAEWQVYKEEISRFK
EQLTPSQIMSLEKEIMDKHLKRKAMTKKKELTLLGKPKRPRSAYNVYV
AERFQEAKGDSPQEKLKTVKENWKNLSDSEKELYIQHAKEDETRYHNE
MKSWEEQMIEVGRKDLLRRTIKKQRKYGAEEC

Selected Model Organism Protein Similarities That Can Be Used In The Compositions And Methods Disclosed Herein: Organism, Protein And Percent Identity And Length Of Aligned Region

| | | |
|---|---|---|
| H. sapiens (SEQ. ID. NO.: 211): | sp: Q00059 - MTT1_HUMAN Transcription factor 1, mitochondrial precursor | 100%/246 aa (see ProtEST) |
| | (MTTF1) | |
| M. musculus (SEQ. ID. NO.: 212): | ref: NP_033386.1 - transcription factor A, mitochondrial [Mus musculus] | 63%/237 aa (see ProtEST) |
| R. norvegicus: (SEQ. ID. NO.: 213): | ref: NP_112616.1 - transcription factor A, mitochondrial [Rattus norvegicus] | 64%/237 aa (see ProtEST) |
| A. thaliana (SEQ. ID. NO.: 214):: | ref: NP_192846.1 - 98b like protein [Arabidopsis thaliana] | 27%/189 aa (see ProtEST) |
| C. elegans (SEQ. ID. NO.: 215):: | ref: NP_501245.1 - F45E4.9.p [Caenorhabditis elegans] | 27%/189 aa (see ProtEST) |
| D. melanogaster: (SEQ. ID. NO.: 216): | ref: NP_524415.1 - mitochondrial transcription factor A [Drosophila melanogaster] | 34%/183 aa (see ProtEST) |

Sequence data for the sequences referenced herein are known in the art, for example in GenBank, and are incorporated by reference herein, in their entirety.

It should be emphasized that the above-described embodiments of the present disclosure, particularly, any "preferred" embodiments, are merely possible examples of implementations, merely set forth for a clear understanding of the principles of the disclosure. Many variations and modifications may be made to the above-described embodiment(s) of the disclosure without departing substantially from the spirit and principles of the disclosure. All such modifications and variations are intended to be included herein within the scope of this disclosure and the present disclosure and protected by the following claims.

SEQUENCE LISTING (218 sequences)

SEQ ID NO: 1 - protein, 11 aa, Human immunodeficiency virus
YGRKKRRQRRR

SEQ ID NO: 2 - protein, 9 aa, Human immunodeficiency virus
RKKRRQRRR

SEQ ID NO: 3 - protein, 7 aa, artificial sequence
  AP-1 concensus site
TGACTCA

SEQ ID NO: 4 - protein, 16 aa, Drosophila melanogaster
RQIKIWFQNRRMKWKK

SEQ ID NO: 5 - protein, 86 aa, HIV
MEPVDPRLEPWKHPGSQPKTACTNCYCKKCCFHCQVCFITKALGISYGRKKRRQRRRAHQNSETHQASLSKQPTSQPRGDPTGPKE

SEQ ID NO: 6 - protein, 7 aa, artificial sequence
  protein transduction domain
RRRRRRR

SEQ ID NO: 7 - protein, 12 aa, artificial sequence
  protein transduction domain
RRQRRTSKLMKR

SEQ ID NO: 8 - protein, 27 aa, artificial sequence
  protein transduction domain
GWTLNSAGYLLGKINLKALAALAKKIL

SEQ ID NO: 9 - protein, 29 aa, artificial sequence
  protein transduction domain
WEAKLAKALAKALAKHLAKALAKALKCEA

SEQ ID NO: 10 - protein, 7 aa, artificial sequence
  SV40 Tantigen nuclear localization signal
PKKKRKV

SEQ ID NO: 11 - protein, 7 aa, artificial sequence
  nuclear localization signal
GKKRSKV

SEQ ID NO: 12 - protein, 7 aa, artificial sequence
  nuclear localization signal
KSRKRKL

SEQ ID NO: 13 - protein, 19 aa, artificial sequence
  nuclear localization signal
KRPAATKKAGQAKKKKLDK

SEQ ID NO: 14 - protein, 20 aa, artificial sequence
  nuclear localization signal
RKKRKTEEESPLKDKAKKSK

SEQ ID NO: 15 - protein, 20 aa, artificial sequence
  nuclear localization signal
KDCVMNKHHRNRCQYCRLQR

SEQ ID NO: 16 - protein, 9 aa, artificial sequence
  nuclear localization signal
PAAKRVKLD

SEQ ID NO: 17 - protein, 20 aa, artificial sequence
  nuclear localization signal
KKYENVVIKRSPRKRGRPRK

SEQ ID NO: 18 - protein, 252 aa, Mus musculus
MRALVAVKRVIDFAVKIRVKPDKSGVVTDGVKHSMNPFCEIAVEEAVRLKEKKLVKEIIAVSCGPSQCQETIRTALAMGADRGIHVEIPGAQAESLGPLQVARVLAKLAEKEKVDLLFLGKQAIDDDCNQTGQMTAGLLDWPQGTFASQVTLEGDKVKVEREIDGGLETLRLKLPAVVTADLRLNEPRYATLPNIMKAKKKKIEVVKAGDLGVDLTSKVSVISVEEPPQRSAGVKVETTEDLVAKLKEVGRI

SEQ ID NO: 19 - protein, 333 aa, Mus musculus
MFRAAAPGQLRRAASLLRFQSTLVIAEHANDSLAPITLNTITAAGRLGGEVSCLVAGTKCDKVVQDLCKVAGVAKVLVAQHDAYKGLLPEELTPLILETQKQFSYTHICAGASAFGKNLLPRVAAKLNVAPVSDIIEIKSPDTFVRTIYAGNALCTVKCDEKVKVFSVRGTSFEAAATSGGSASSEKAPSSSSVGISEWLDQKLTKSDPPELTGAKVVVSGGRGLKSGENFKLLYDLADQLHAAVGASRAAVDAGFVPNDMQVGQTGKIVAPELYIAVGISGAIQHLAGMKDSKTIVAINKDPEAPIFQVADYGIVADLFKVVPEMTEILKKK

SEQ ID NO: 20 - protein, 509 aa, Homo sapiens
MQSWSRVYCSLAKRGHFNRISHGLQGLSAVPLRTYADQPIDADVTVIGSGPGGYVAAIKAAQLGFKTVCIEKNETLGGTCLNVGCIPSKALLNNSHYYHMAHGTDFASRGIEMSEVRLNLDKMMEQKSTAVKALTGGIAHLFKQNKVVHVNGYGKITGKNQVTATKADGGTQVIDTKNILIATGSEVTPFPGITIDEDTIVSSTGALSLKKVPEKMVVIGAGVIGVELGSVWQRLGADVTAVEFLGHVGGVGIDMEISKNFQRILQKQGFKFKLNTKVTGATKKSDGKIDVSIEAASGGKAEVITCDVLLVCIGRRPFTKNLGLEELGIELDPRGRIPVNTRFQTKIPNIYAIGDVVAGPMLAHKAEDEGIICVEGMAGGAVHIDYNCVPSVIYTHPEVAWVGKSEEQLKEEGIEYKVGKFPFAANSRAKTNADTDGMVKILGQKSTDRVLGAHILGPGAGEMVNEAALALEYGASCEDIARVCHAHPTLSEAFREANLAASFGKSINF

SEQ ID NO: 21 - protein, 227 aa, Mus musculus
MGASGRLLRAVIMGAPGSGKGTVSSRITKHFELKHLSSGDLLRQNMLQGTEIGVLAKTFIDQGKLIPDDVMTRLALHELKTLTQCSWLLDGFPRTLPQAEALDKVYQIDTVINLNVPFEVIKQRLTARWIHPASGRVYNIEFNPPKTVGIDDLTGEPLIQREDDKPETVIKRLKAYEAQTEPVLQYYQKKGVLETFSGTETNKIWPHVYSFLQTKVPETTQKASVTP

SEQ ID NO: 22 - protein, 464 aa, Mus musculus
MALLTAATRLLGAKNSSCLVLAARHASASSTNLKDVLSNLIPKEQARIKTFKQQHGKTVVGQITVDMMYGGMRGMKGLVYETSVLDPDEGIRFRGYSIPECQKMLPKAKGGEEPLPEGLFWLLVTGQMPTEEQVSWLSREWAKRAALPSHVVTMLDNFPTNLHPMSQLSAAITALNSESNFARAYAEGMNRAKYWELIYEDCMDLIAKLPCVAAKIYRNLYREGSSIGAIDSRLDWSHNFTNMLGYTDPQFTELMRLYLTIHSDHEGGNVSAHTSHLVGSALSDPYLSFAAAMNGLAGPLHGLANQEVLVWLTQLQKEVGKDVSDEKLRDYIWNTLNSGRVVPGYGHAVLRKTDPRYSCQREFALKHLPKDPMFKLVAQLYKIVPNILLEQGKAKNPWPNVDAHSGVLLQYYGMTEMNYYTVLFGVSRALGVLAQLIWSRALGFPLERPKSMSTDGLMKFVDSK

SEQ ID NO: 23 - protein, 1500 aa, Homo sapiens
MTRILTAFKVVRTLKTGFGFTNVTAHQKWKFSRPGIRLLSVKAQTAHIVLEDGTKMKGYSFGHPSSVAGEVVFNTGLGGYPEAITDPAYKGQILTMANPIIGNGGAPDTTALDELGLSKYLESNGIKVSGLLVLDYSKDYNHWLATKSLGQWLQEEKVPAIYGVDTRMLTKIIRDKGTMLGKIEFEGQPVDFVDPNKQNLIAEVSTKDVKVYGKGNPTKVVAVDCGIKNNVIRLLVKRGAEVHLVPWNHDFTKMEYDGILIAGGPGNPALAEPLIQNVRKILESDRKEPLFGISTGNLITGLAAGAKTYKMSMANRGQNQPVLNITNKQAFITAQNHGYALDNTLPAGWKPLFVNVNDQTNEGIMHESKPFFAVQFHPEVTPGPIDTEYLFDSFFSLIKKGKATTITSVLPKPALVASRVEVSKVLILGSGGLSIGQAGEFDYSGSQAVKAMKEENVKTVLMNPNIASVQTNEVGLKQADTVYFLPITPQFVTEVIKAEQPDGLILGMGGQTALNCGVELFKRGVLKEYGVKVLGTSVESIMATEDRQLFSDKLNEINEKIAPSFAVESIEDALKAADTIGYPVMIRSAYALGGLGSGICPNRETLMDLSTKAFAMTNQILVEKSVTGWKEIEYEVVRDADDNCVTVCNMENVDAMGVHTGDSVVVAPAQTLSNAEFQMLRRTSINVVRHLGIVGECNIQFALHPTSMEYCIIEVNARLSRSSALASKATGYPLAFIAAKIALGIPLPEIKNVVSGKTSACFEPSLDYMVTKIPRWDLDRFHGTSSRIGSSMKSVGEVMAIGRTFEESFQKALRMCHPSIEGFTPRLPMNKEWPSNLDLRKELSEPSSTRIYAIAKAIDDNMSLDEIEKLTYIDKWFLYKMRDILNMEKTLKGLNSESMTEETLKRAKEIGFSDKQISKCLGLTEAQTRELRLKKNIHPWVKQIDTLAAEYPSVTNYLYVTYNGQEHDVNFDDHGMMVLGCGPYHIGSSVEFDWCAVSSIRTLRQLGKKTVVVNCNPETVSTDFDECDKLYFEELSLERILDIYHQEACGGCIISVGGQIPNNLAVPLYKNGVKIMGTSPLQIDRAEDRSIFSAVLDELKVAQAPWKAVNTLNEALEFAKSVDYPCLLRPSYVLSGSAMNVVFSEDEMKKFLEEATRVSQEHPVVLTKFVEGAREVEMDAVGKDGRVISHAISEHVEDAGVHSGDATLMLPTQTISQGAIEKVKDATRKIAKAFAISGPFNVQFLVKGNDVLVIECNLRASRSFPFVSKTLGVDFIDVATKVMIGENVDEKHLPTLDHPIIPADYVAIKAPMFSWPRLRDADPILRCEMASTGEVACFGEGIHTAFLKAMLSTGFKIPQKGILIGIQQSFRPRFLGVAEQLHNEGFKLFATEATSDWLNANNVPATPVAWPSQEGQNPSLSSIRKLIRDGSIDLVINLPNNNTKFVHDNYVIRRTAVDSGIPLLTNFQVTKLFAEAVQKSRKVDSKSLFHYRQYSAGKAA

SEQ ID NO: 24 - protein, 572 aa, Mus musculus
MEPRAPRRRHTHQRGYLLTRDPHLNKDLAFTLEERQQLNIHGLLPPCIISQELQVLRIIKNFERLNSDFDRYLLLMDLQDRNEKLFYSVLMSDVEKFMPIVYTPTVGLACQQYSLAFRKPRGLFISIHDKGHIASVLNAWPEDVVKAIVVTDGERILGLGDLGCNGMGIPVGKLALYTACGGVNPQQCLPITLDVGTENEELLKDPLYIGLRHRRVRGPEYDAFLDEFMEAASSKYGMNCLIQFEDFANRNAFRLLNKYRNKYCTFNDDIQGTASVAVAGLLAALRITKNKLSDQTVLFQGAGEAALGIAHLVVMAMEKEGLSKENARKKIWLVDSKGLIVKGRASLTEEKEVFAHEHEEMKNLEAIVQKIKPTALIGVAAIGGAFTEQILKDMAAFNERPIIFALSSPTSKAECSADECYKVTKGRAIFASGSPFDPVTLPDGRTLFPGQGNNSYVFPGVALGVVACGLRHIDDKVFLTTREVISQQVSDKHLQEGRLYPPLNTIRGVSLKIAVKIVQDAYKEKMATVYPEPQNKEEFVSSQMYSTNYDQILPDCYPWPAEVQKIQTKVNQ

SEQ ID NO: 25 - protein, 724 aa, Mus musculus
MAGQWVRTVALLAARRHWRRSSQQQLLGTLKHAPVYSYQCLVVSRSLSSVEYEPKEKTFDKILIANRGEIACRVIKTCKKMGIKTVAIHSDVDASSVHVKMADEAVCVGPAPTSKSYLNMDAIMEAIKKTRAQAVHPGYGFLSENKEFAKRLAAEDVTFIGPDTHAIQAMGDKIESKLLAKRAKVNTIPGFDGVVKDADEAVRIAREIGYPVMIKASAGGGGKGMRIAWDDEETRDGFRFSSQEAASSFGDDRLLIEKFIDNPRHIEIQVLGDKHGNALWLNERECSIQRRNQKVVEEAPSIFLDPETRQAMGEQAVALAKAVKYSSAGTVEFLVDSQKNFYFLEMNTRLQVEHPVTECITGLDLVQEMILVAKGYPLRHKQEDIPISGWAVECRVYAEDPYKSFGLPSIGRLSQYQEPIHLPGVRVDSGIQPGSDISIYYDPMISKLVTYGSDRAEALKRMEDALDNYVIRGVTHNIPLLREVIINTRFVKGDISAKFLSDVYPDGFKGHTLTLSERNQLLAIASSVFVASQLRAQRFQEHSRVPVIRPDVAKWELSVKVHDEDHTVVASNNGPAFTVEVDGSKLNVTSTWNLASPLLSVNVDGTQRTVQCLSREAGGNMSIQFLGTVYKVHILTKLAAELNKFMLEKVPKDTSSTLCSPMPGVVVAVSVKPGDMVAEGQEICVIEAMKMQNSMTAGKMGKVKLVHCKAGDTVGEGDLLVELE

SEQ ID NO: 26 - protein, 703 aa, Homo sapiens
MLSAALRTLKHVLYYSRQCLMVSRNLGSVGYDPNEKTFDKILVANRGEIACRVIRTCKKMGIKTVAIHSDVDASSVHVKMADEAVCVGPAPTSKSYLNMDAIMEAIKKTRAQAVHPGYGFLSENKEFARCLAAEDVVFIGPDTHAIQAMGDKIESKLLAKKAEVNTIPGFDGVVKDAEEAVRIAREIGYPVMIKASAGGGGKGMRIAWDDEETRDGFRLSSQEAASSFGDDRLLIEKFIDNPRHIEIQVLGDKHGNALWLNERECSIQRRNQKVVEEAPSIFLDAETRRAMGEQAVALARAVKYSSAGTVEFLVDSKKNFYFLEMNTRLQVEHPVTECITGLDLVQEMIRVAKGYPLRHKQADIRINGWAVECRVYAEDPYKSFGLPSIGRLSQYQEPLHLPGVRVDSGIQPGSDISIYYDPMISKLITYGSDRTEALKRMADALDNYVIRGVTHNIALLREVIINSRFVKGDISTKFLSDVYPDGFKGHMLTKSEKNQLLAIASSLFVAFQLRAQHFQENSRMPVIKPDIANWELSVKLHDKVHTVVASNNGSVFSVEVDGSKLNVTSTWNLASPLLSVSVDGTQRTVQCLSREAGGNMSIQFLGTVYKVNILTRLAAELNKFMLEKVTEDTSSVLRSPMPGVVVAVSVKPGDAVAEGQEICVIEAMKMQNSMTAGKTGTVKSVHCQAGDTVGEGDLLVELE

SEQ ID NO: 27 - protein, 244 aa, Mus musculus
MKLNFSGLRALVTGAGKGIGRDTVKALHASGAKVVAVTRTNSDLVSLAKECPGIEPVCVDLGDWDATEKALGGIGPVDLLVNNAALVIMQPFLEVTKEAFDRSFSVNLRSVFQVSQMVARDMINRGVPGSIVNVSSMVAHVTFPNLITYSSTKGAMTMLTKAMAMELGPHKIRVNSVNPTVVLTDMGKKVSADPEFARKLKERHPLRKFAEVEDVVNSILFLLSDRSASTSGGGILVDAGYLAS

SEQ ID NO: 28 - protein, 476 aa, Neurospora crassa
MASRRLALNLAQGVKARAGGVINPFRRGLATPHSGTGIKTQTTTLKNGLTVASQYSPYAQTSTVGMWIDAGSRAETDETNGTAHFLEHLAFKGTTKRTQQQLELEIENMGAHLNAYTSRENTVYFAKALNEDVPKCVDILQDILQNSKLEESAIERERDVILRESEEVEKQLEEVVFDHLHATAYQHQPLGRTILGPRENIRDITRTELVNYIKNNYTADRMVLVGAGGVPHEQLVEMADKYFSKLPATAPVSSASILSKKKPDFIGSDIRIRDDTIPTANIAIAVEGVSWSDDDYFTGLVTQAIVGNYDKALGNAPHQGSKLSGFVHKHDLATSFMSFSTSYSDTGLWGIYLVTDKLDRVDDLVHFSLREWTRLCSNVSEAEVERAKAQLKASILLSLDGTTAVAEDIGRQIVTTGRRMSPAEIERIIDAVSAKDVMDFANKKIWDQDIAISAVGSIEGLFDYARIRGDMSRNAF

SEQ ID NO: 29 - protein, 412 aa, Homo sapiens
MAAALLARASGPARRALCPRAWRQLHTIYQSVELPETHQMLLQTCRDFAEKELFPIAAQVDKEHLFPAAQVKKMGGLGLLAMDVPEELGGAGLDYLAYAIAMEEISRGCASTGVIMSVNNSLYLGPILKFGSKEQKQAWVTPFTSGDKIGCFALSEPGNGSDAGAASTTARAEGDSWVLNGTKAWITNAWEASAAVVFASTDRALQNKGISAFLVPMPTPGLTLGKKEDKLGIRGSSTANLIFEDCRIPKDSILGEPGMGFKIAMQTLDMGRIGIASQALGIAQTALDCAVNYAENRMAFGAPLTKLQVIQFKLADMALALESARLLTWRAAMLKDNKKPFIKEAAMAKLAASEAATAISHQAIQILGGMGYVTEMPAERHYRDARITEIYEGTSEIQRLVIAGHLLRSYRS

SEQ ID NO: 30 - protein, 333 aa, Homo sapiens
MFRAAAPGQLRRAASLLRFQSTLVIAEHANDSLAPITLNTITAATRLGGEVSCLVAGTKCDKVAQDLCKVAGIAKVLVAQHDVYKGLLPEELTPLILATQKQFNYTHICAGASAFGKNLLPRVAAKLEVAPISDIIAIKSPDTFVRTIYAGNALCTVKCDEKVKVFSVRGTSFDAAATSGGSASSEKASSTSPVEISEWLDQKLTKSDRPELTGAKVVVSGGRGLKSGENFKLLYDLADQLHAAVGASRAAVDAGFVPNDMQVGQTGKIVAPELYIAVGISGAIQHLAGMKDSKTIVAINKDPEAPIFQVADYGIVADLFKVVPEMTEILKKK

SEQ ID NO: 31 - protein, 482 aa, Homo sapiens
MAAVRMLRTWSRNAGKLICVRYFQTCGNVHVLKPNYVCFFGYPSFKYSHPHHFLKTTAALRGQVVQFKLSDIGEGIREVTVKEWYVKEGDTVSQFDSICEVQSDKASVTITSRYDGVIKKLYYNLDDIAYVGKPLVDIETEALKDSEEDVVETPAVSHDEHTHQEIKGRKTLATPAVRRLAMENNIKLSEVVGSGKDGRILKEDILNYLEKQTGAILPPSPKVEIMPPPPKPKDMTVPILVSKPPVFTGKDKTEPIKGFQKAMVKTMSAALKIPHFGYCDEIDLTELVKLREELKPIAFARGIKLSFMPFFLKAASLGLLPFPILNASVDENCQNITYKASHNIGIAMDTEQGVIVPNVKNVQICSIFDIATELNRLQKLGSVGQLSTTDLTGGTFTLSNIGSIGGTFAKPVIMPPEVAIGALGSIKAIPRFNQKGEVYKAQIMNVSWSADHRVIDGATMSRFSNLWKSYLENPAFMLLDLK

SEQ ID NO: 32 - protein, 573 aa, Homo sapiens
MLRLPTVFRQMRPVSRVLAPHLTRAYAKDVKFGADARALMLQGVDLLADAVAVTMGPKGRTVIIEQSWGSPKVTKDGVTVAKSIDLKDKYKNIGAKLVQDVANNTNEEAGDGTTTATVLARSIAKEGFEKISKGANPVEIRRGVMLAVDAVIAELKKQSKPVTTPEEIAQVATISANGDKEIGNIISDAMKKVGRKGVITVKDGKTLNDELEIIEGMKFDRGYISPYFINTSKGQKCEFQDAYVLLSEKKISSIQSIVPALEIANAHRKPLVIIAEDVDGEALSTLVLNRLKVGLQVVAVKAPGFGDNRKNQLKDMAIATGGAVFGEEGLTLNLEDVQPHDLGKVGEVIVTKDDAMLLKGKGDKAQIEKRIQEIIEQLDVTTSEYEKEKLNERLAKLSDGVAVLKVGGTSDVEVNEKKDRVTDALNATRAAVEEGIVLGGGCALLRCIPALDSLTPANEDQKIGIEIIKRTLKIPAMTIAKNAGVEGSLIVEKIMQSSSEVGYDAMAGDFVNMVEKGIIDPTKVVRTALLDAAGVASLLTTAEVVVTEIPKEEKDPGMGAMGGMGGGMGGGMF

SEQ ID NO: 33 - protein, 577 aa, Neurospora crassa
MLNRFRPARLVAQSSRCLPLTRARAGPLPVNNARTLATRAAAVNTKEPTERDNITTLSNGVRVASEDLPDAFSGVGVYIDAGSRYENDYVRGASHIMDRLAFKSTSTRTADEMLETVEKLGGNIQCASSRESMMYQAATFNKAIPTAVELMAETIRDPKLTDEELEGQIMTAQYEVNEIWSKAELILPELVHMAAFKDNTLGNPLLCPKERLDYINRDVIQTYRDAFYRPERLVVAFAGVPHERAVKLAEKYFGDMKASDAPGLSRTGSETSVDSLVSESSEASSESSSSSSDSSESSGGLLSKLFSPKAKKATPNPFLTRVPISTEDLTRPAHYTGGFLTLPSQPPPLNPNLPTFTHIQLAFEGLAISDDDIYALATLQTLLGGGGSFSAGGPGKGMYSRLYTNVLNQHGWVESCVAFNHSYTDSGLFGIAASCYPGRTLPMLQVMCRELHALTTDHGYSALGELEVSRAKNQLRSSLLMNLESRMVELEDLGRQVQVHGRKIPVREMTRRINELTVKDLRRVAKRVVGGMANNAGQGSGAPTVVLQEATVQGLKTTELGWDQIQDTIAQWKLGRR

SEQ ID NO: 34 - protein, 423 aa, Homo sapiens
MATATRLLGWRVASWRLRPPLAGFVSQRAHSLLPVDDAINGLSEEQRQLRQTMAKFLQEHLAPKAQEIDRSNEFKNLREFWKQLGNLGVLGITAPVQYGGSGLGYLEHVLVMEEISRASGAVGLSYGAHSNLCINQLVRNGNEAQKEKYLPKLISGEYIGALAMSEPNAGSDVVSMKLKAEKKGNHYILNGNKFWITNGPDADVLIVYAKTDLAAVPASRGITAFIVEKGMPGFSTSKKLDKLGMRGSNTCELIFEDCKIPAANILGHENKGVYVLMSGLDLERLVLAGGPLGLMQAVLDHTIPYLHVREAFGQKIGHFQLMQGKMADMYTRLMACRQYVYNVAKACDEGHCTAKDCAGVILYSAECATQVALDGIQCFGGNGYINDFPMGRFLRDAKLYEIGAGTSEVRRLVIGRAFNADFH

SEQ ID NO: 35 - protein, 392 aa, Homo sapiens
MAVVAAAAGWLLRLRAAGAEGHWRRLPGAGLARGFLHPAATVEDAAQRRQVAHFTFQPDPEPREYGQTQKMNLFQSVTSALDNSLAKDPTAVIFGEDVAFGGVFRCTVGLRDKYGKDRVFNTPLCEQGIVGFGIGIAVTGATAIAEIQFADYIFPAFDQIVNEAAKYRYRSGDLFNCGSLTIRSPWGCVGHGALYHSQSPEAFFAHCPGIKVVIPRSPFQAKGLLLSCIEDKNPCIFFEPKILYRAAAEEVPIEPYNIPLSQAEVIQEGSDVTLVAWGTQVHVIREVASMAKEKLGVSCEVIDLRTIIPWDVDTICKSVIKTGRLLISHEAPLTGGFASEISSTVQEECFLNLEAPISRVCGYDTPFPHIFEPFYIPDKWKCYDALRKMINY

SEQ ID NO: 36 - protein, 1000 aa, Homo sapiens
MFHLRTCAAKLRPLTASQTVKTFSQNRPAAARTFQQIRCYSAPVAAEPFLSGTSSNYVEEMYCAWLENPKSVHKSWDIFFRNTNAGAPPATLPESPSLSRGSLAAVAHAQSLVEAQPNVDKLVEDHLAVQSLIRAYQIRGHHVAQLDPLGILDADLDSSVAPLTLSHPQTDLGWMSLTSTRSSTCPPTTFIGGQESALPLREIIRRLEMAYCQHIGVEFMFINDLEQCQWIRQKFETPGIMQFTNEEKRTLLARLVRSTRFEEFLQRKWSSEKRFGLEGCEVLIPALKTIIDKSSENGVDYVIMGMPHRGRLNVLANVIRKELEQIFCQFDSKLEAADEGLRRCEVPPGHVSPQDQSCHRPGTLPCPWWPNPSHLEAADPVVMGKTKAEQFYCGDTEGKKVMSILLHGDAAFAGQGIVYETFHLSDLPSYTTHGTVHVVVNNQIGFTTDPRMARSSPYPTDVARVVNAPIFHVNSDDPEAVMYVCKVAAEWRSTFHKDVVVDLVCYRRNGHNEMDEPMFTQPLMYKQIRKQKPVLQKYAELLVSQGVVNQPEYEEEISKYDKICEEAFARSKDEKILHIKHWLDSPWPGFFTLDGQPRSMSCPSTGLTEDILTHIGNVASSVPVENFTIHGGLSRILKTRGEMVKNRTVDWALAEYMAFGSLLKEGIHIRLSGQDVERGTFSHRHHVLHDQNVDKRTCIPMNHLWPNQAPYTVCNSSLSEYGVLGFGAGLRMASPNALVLWEAQFGDFHNTAQCIIDQFICPGQAKWVRQNGIVLLLPLGMEGMGPEHSSGPPRAFLQMCNDDPDVLPDLKEANFDINQLYDCNWVVVNCSTPGNFFHVLRRQILLPFRKPLIIFTPKSLLRHPEARSSFDEMLPGTHFQRVIPEDGPAAQNPENVKRLLFCTGKVYYDLTRERKARDMVGQVAITRIEHVSPFPFDLLLKEVQKYPNAELAWCQEEHKNQGYYDYVKPRLRTTISRAKPVWYAGRDPAAAPRTGNKKTH

SEQ ID NO: 37 - protein, 584 aa, Homo sapiens
MLSRLRVVSTTCTLACRHLHIKEKGKPLMLNPRTNKGMAFTLQERQMLGLQGLLPPKIETQDIQALRFHRNLKKMTSPLEKYIYIMGIQERNEKLFYRILQDDIESLMPIVYTPTVGLACSQYGHIFRRPKGLFISISDRGHVRSIVDNWPENHVKAVVVTDGERILGLGDLGVYGMGIPVGKLCLYTACAGIRPDRCLPVCIDVGTDNIALLKDPFYMGLYQKRDRTQQYDDLIDEFMKAITDRYGRNTLIQFEDFGNHNAFRFLRKYREKYCTFNDDIQGTAAVALAGLLAAQKVISKPISEHKILFLGAGEAALGIANLIVMSMVENGLSEQEAQKKIWMFDKYGLLVKGRKAKIDSYQEPFTHSAPESIPDTFEDAVNILKPSTIIGVAGAGRLFTPDVIRAMASINERPVIFALSNPTAQAECTAEEAYTLTEGRCLFASGSPFGPVKLTDGRVFTPGQGNNVYIFPGVALAVILCNTRHISDSVFLEAAKALTSQLTDEELAQGRLYPPLANIQEVSINIAIKVTEYLYANKMAFRYPEPEDKAKYVKERTWRSEYDSLLPDVYEWPESASSPPVITE

SEQ ID NO: 38 - protein, 496 aa, Homo sapiens
MASRCWRWWGWSAWPRTRLPPAGSTPSFCHHFSTQEKTPQICVVGSGPAGFYTAQHLLKHPQAHVDIYEKQPVPFGLVRFGVAPDHPEVKNVINTFTQTAHSGRCAFWGNVEVGRDVTVPELQEAYHAVVLSYGAEDHRALEIPGEELPGVCSARAFVGWYNGLPENQELEPDLSCDTAVILGQGNVALDVARILLTPPEHLEALLLCQRTDITLAALGVLRQSRVKTVWLVGRRGPLQVAFTILELREMIQLPGARPILDPVDFLGLQDKIKEVPRPRKRLTELLLRTATEKPGPAEAARQASASRAWGLRFFRSPQQVLPSPDGRRAAGVRLAVTRLEGVDEATRAVPTGDMEDLPCGLVLSSIGYKSRPVDPSVPFDSKLGVIPNVEGRVMDVPGLYCSGWVLRGPTGVIATTMTDSFLTGQMLLQDLKAGLLPSGPRPGYAAIQALLSSRGVRPVSFSDWKLDAEEVARGQGTGKPREKLVDPQGMLRLLGH

SEQ ID NO: 39 - protein, 430 aa, Homo sapiens [sequence omitted]

SEQ ID NO: 40 - protein, 517 aa, Homo sapiens [sequence omitted]

SEQ ID NO: 41 - protein, 207 aa, Homo sapiens
MLALRCGSRWLGLLSVPRSVPLRLPAARACSKGSGDPSSSSSSGNPLVYLDVDANGKPLGRVVLELKADVVPKTAENFRALCTGEKGFGYKGSTFHRVIPSFMCQAGDFTNHNGTGGKSIYGSRFPDENFTLKHVGPGVLSMANAGPNTNGSQFFICTIKTDWLDGKHVVFGHVKEGMDVVKKIESFGSKSGRTSKKIVITDCGQLS

SEQ ID NO: 42 - protein, 453 aa, Neurospora crassa
MFSRLAARLPKASALNGVAARQVRNLSQPAITGSKGRNMPAREPRTTAAATGAEATFTIRDGPVFQGTAFGANTNISGEAVFTTSLVGYPESMTDPSYRGQILVFTQPLIGNYGVPSNERDEFNLLSTSSLPTSSAPVSLSPMSLPSTATGLLFRAWASGAPARAFPPLSGVDTRAIVTYLREQGSSLARISIGDEYDADEDEGFIDPGQINLVKRVSTKAPFVVTNPNAKFHVALIDCGVKENILRSLVSRGASVTVFPYNYPIHKVAENFDGVFISNGPGDPTHCQETVYNLAKLMETSPIPIMGICLGHQLLALAVGAKTIKLSMVIRAHNIPALDLTTGQCHITSQNHGYAVDISTLPSDFKEYFVNLNDGSNEGMMHKTRPIFSTQFHPEAKGGPMDSSYLFDKYMENVELFKSNSQVYRDNRPTQFMIDILSKERVGVEPTPLSNAA

SEQ ID NO: 43 - protein, 343 aa, Homo sapiens
GLRPPPPGRFSRLPGKTLSACDRENGARRPLLLGSTSFIPIGRRTYASAAEPVGSKAVLVTGCDSGFGFSLAKHLHSKGFLVFAGCLMKDKGHDGVKELDSLNSDRLRTVQLNVFRSEEVEKVVGDCPFEPEGPEKGMWGLVNNAGISTFGEVEFTSLETYKQVAEVNLWGTVRMTKSFLPLIRRAKGRVVNISSMLGRMANPARSPYCITKFGVEAFSDCLRYEMYPLGVKVSVVEPGNFIAATSLYNPESIQAIAKKMWEELPEVVRKDYGKKYFDEKIAKMETYCSSGSTDTSPVIDAVTHALTATTPYTRYHPMDYYWWLRMQIMTHLPGAISDMIYIR

SEQ ID NO: 44 - protein, 325 aa, Homo sapiens
MAAMRKALPRRLVGLASLRAVSTSSMGTLPKRVKIVEVGPRDGLQNEKNIVSTPVKIKLIDMLSEAGLSVIETTSFVSPKWVPQMGDHTEVLKGIQKFPGINYPVLTPNLKGFEAAVAAGAKEVVIFGAASELFTKKNINCSIEESFQRFDAILKAAQSANISVRGYVSCALGCPYEGKISPAKVAEVTKKFYSMGCYEISLGDTIGVGTPGIMKDMLSAVMQEVPLAALAVHCHDTYGQALANTLMALQMGVSVVDSSVAGLGGCPYAQGASGNLATEDLVYMLEGLGIHTGVNLQKLLEAGNFICQALNRKTSSKVAQATCKL

SEQ ID NO: 45 - protein, 1178 aa, Mus musculus
MLKFQTVRGGLRLLGVRRSSSAPVASPNVRRLEYKPIKKVMVANRGEIAIRVFRACTELGIRTVAVYSEQDTGQMHRQKADEAYLIGRGLAPVQAYLHIPDIIKVAKENGVDAVHPGYGFLSERADFAQACQDAGVRFIGPSPEVVRKMGDKVEARAIAIAAGVPVVPGTDSPISSLHEAHEFSNTFGFPIIFKAAYGGGGRGMRVVHSYEELEENYTRAYSEALAAFGNGALFVEKFIEKPRHIEVQILGDQYGNILHLYERDCSIQRRHQKVVEIAPATHLDPQLRSRLTSDSVKLAKQVGYENAGTVEFLVDKHGKHYFIEVNSRLQVEHTVTEEITDVDLVHAQIHVSEGRSLPDLGLRQENIRINGCAIQCRVTTEDPARSFQPDTGRIEVFRSGEGMGIRLDNASAFQGAVISPHYDSLLVKVIAHGKDHPTAATKMSRALAEFRVRGVKTNIPFLQNVLNNQQFLAGTVDTQFIDENPELFQLRPAQNRAQKLLHYLGHVMVNGPTTPIPVNVSPSPVDPAVPVVPIGPPPAGFRDILLREGPEGFARAVRNHQGLLLMDTTFRDAHQSLLATRVRTHDLKKIAPYVAHNFNKLFSMENWGGATFDVAMRFLYECPWRRLQELRELIPNIPFQMLLRGANAVGYTNYPDNVVFKFCEVAKENGMDVFRVFDSLNYLPNMLLGMEAAGSAGGVVEAAISYTGDVADPSRTKYSLEYYMGLAEELVRAGTHILCIKDMAGLLKPAACTMLVSSLRDRFPDLPLHIHTHDTSGAGVAAMLACAQAGADVVDVAVDSMSGMTSQPSMGALVACTKGTPLDTEVPLERVFDYSEYWEGARGLYAAFDCTATMKSGNSDVYENEIPGGQYTNLHFQAHSMGLGSKFKEVKKAYVEANQMLGDLIKVTPSSKIVGDLAQFMVQNGLSRAEAEAQAEELSFPRSVVEFLQGYIGIPHGGFPEPFRSKVLKDLPRIEGRPGASLPPLNLKELEKDLIDRHGEEVTPEDVLSAAMYPDVFAQFKDFTATFGPLDSLNTRLFLQGPKIAEEFEVELERGKTLHIKALAVSDLNRAGQRQVFFELNGQLRSILVKDTQAMKEMHFHPKALKDVKGQIGAPMPGKVIDIKVAAGDKVAKGQPLCVLSAMKMETVVTSPMEGTIRKVHVTKDMTLEGDDLILEIE

SEQ ID NO: 46 - protein, 539 aa, Homo sapiens
MAAALRVAAVGARLSVLASGLRAAVRSLCSQATSVNERIENKRRTALLGGGQRRIDAQHKRGKLTARERISLLLDPGSFVESDMFVEHRCADFGMAADKNKFPGDSVVTGRGRINGRLVYVFSQDFTVFGGSLSGAHAQKICKIMDQAITVGAPVIGLNDSGGARIQEGVESLAGYADIFLRNVTASGVIPQISLIMGPCAGGAVYSPALTDFTFMVKDTSYLFITGPDVVKSVTNEDVTQEELGGAKTHTTMSGVAHRAFENDVDALCNLRDFFNYLPLSSQDPAPVRECHDPSDRLVPELDTIVPLESTKAYNMVDIIHSVVDEREFFEIMPNYAKNIIVGFARMNGRTVGIVGNQPKVASGCLDINSSVKGARFVRFCDAFNIPLITFVDVPGFLPGTAQEYGGIIRHGAKLLYAFAEATVPKVTVITRKAYGGAYDVMSSKHLCGDTNYAWPTAEIAVMGAKGAVEIIFKGHENVEAAQAEYIEKFANPFPAAVRGFVDDIIQPSSTRARICCDLDVLASKKVQRPWRKHANIPL

SEQ ID NO: 47 - protein, 558 aa, Homo sapiens
MYRYLAKALLPSRAGPAALGSAANHSAALLGRGRGQPAAASQPGLALAARRHYSELVADREDDPNFFKMVEGFFDRGASIVEDKLVKDLRTQESEEQKRNRVRGILRIIKPCNHVLSLSFPIRRDDGSWEVIEGYRAQHSQHRTPCKGGIRYSTDVSVDEVKALASLMTYKCAVVDVPFGGAKAGVKINPKNYTENELEKITRRFTMELAKKGFIGPGVDVPAPDMNTGEREMSWIADTYASTIGHYDINAHACVTGKPISQGGIHGRISATGRGVFHGIENFINEASYMSILGMTPGFRDKTFVVQGFGNVGLHSMRYLHRFGAKCIAVGESDGSIWNPDGIDPKELEDFKLQHGSILGFPKAKPYEGSILEVDCDILIPAATEKQLTKSNAPRVKAKIIAEGANGPTTPEADKIFLERNILVIPDLYLNAGGVTVSYFEWLKNLNHVSYGRLTFKYERDSNYHLLLSVQESLERKFGKHGGTIPIVPTAEFQDSISGASEKDIVHSALAYTMERSARQIMHTAMKYNLGLDLRTAAYVNAIEKVFKVYSEAGVTFT

SEQ ID NO: 48 - protein, 102 aa, Mus musculus
MAGQAFRKFLPLFDRVLVERSAAETVTKGGIMLPEKSQGKVLQATVVAVGSGGKGKSGEIEPVSVKVGDKVLLPEYGGTKVVLDDKDYFLFRDSDILGKYVD

SEQ ID NO: 49 - protein, 432 aa, Homo sapiens
MEGLAVRLLRGSRLLRRNFLTCLSSWKIPPHVSKSSQSEALLNITNNGIHFAPLQTFTDEEMMIKSSVKKFAQEQIAPLVSTMDENSKMEKSVIQGLFQQGLMGIEVDPEYGGTGASFLSTVLVIEELAKVDASVAVFCEIQNTLINTLIRKHGTEEQKATYLPQLTTEKVGSFCLSEAGAGSDSFALKTRADKEGDYYVLNGSKMWISSAEHAGLFLVMANVDPTIGYKGITSFLVDRDTPGLHIGKPENKLGLRASSTCPLTFENVKVPEANILGQIGHGYKYAIGSLNEGRIGIAAQMLGLAQGCFDYTIPYIKERIQFGKRLFDFQGLQHQVAHVATQLEAARLLTYNAARLLEAGKPFIKEASMAKYYASEIAGQTTSKCIEWMGGVGYTKDYPVEKYFRDAKIGTIYEGASNIQLNTIAKHIDAEY

SEQ ID NO: 50 - protein, 302 aa, Homo sapiens
MALVASVRVPARVLLRAGARLPGAALGRTERAAGGGDGARRFGSQRVLVEPDAGAGVAVMKFKNPPVNSLSLEFLTELVISLEKLENDKSFRGVILTSDRPGVFSAGLDLTEMCGRSPAHYAGYWKAVQELWLRLYQSNLVLVSAINGACPAGGCLVALTCDYRILADNPRYCIGLNETQLGIIAPFWLKDTLENTIGHRAAERALQLGLLFPPAEALQVGIVDQVVPEEQVQSTALSAIAQWMAIPDHARQLTKAMMRKATASRLVTQRDADVQNFVSFISKDSIQKSLQMYLERLKEEKG

SEQ ID NO: 51 - protein, 421 aa, Mus musculus [sequence omitted]

SEQ ID NO: 52 - DNA, 2875 bp, Homo sapiens
acggctccgcccttctcaagatggcgctgcactcaatgcggaaagcgcgtgagcgctggagcttcatccgggcacttcataagggatccgcagctgctcccgctctccagaaagacagcaagaagcgagtattttccggcattcaacctacaggaatcctccacctgggcaattacctgggagccattgagagctgggtgaggttacaggatgaatatgactctgtattatacagcattgttgacctccactccattactgtcccccaagacccagctgtccttcggcagagcatcctggacatgactgctgttcttcttgcctgtggcataaacccggaaaaaagcatccttttccaacaatctcaggtgtctgaacacacacaattaagttggatcctttcctgcatggtcagactacctcgattacaacatttacatcagtggaaggcaaagactaccaagcagaagcacgatggcacggtgggcctgctcacatacccagtactccaggcagccgacattctgttgtacaagtccacacacgttcctgttggggaggatcaagtccagcacatggaactagttcaggatctagcacaaggtttcaacaagaagtatggggagttctttccagtgcccgagtccattctcagtatgtgtgtgttggtgtttttaacctagcatccatgaagaaggtaaaatccctacgtgatccttctgccaaaatgtcgaaatcagaccctgacaaactggccaccgtccgaataacagacagcccagaggagatagtgcagaaattccgcaaggctgtgacagacttcacctcggaggtcacctatgacccggctggccgcgctggcgtgtccaacatagtggcggtgcatgccgcggtgacggggctctccgtggaggaagtggtgcgccgcagcgcgggcatgaacactgctcgctacaagctggccgtggcagatgctgtgattgagaagtttgccccaattaagcgtgaaattgaaaaactgaagctggacaaggaccatttagagaaggttttacaaattggatcagcaaaagccaaagaattagcatacactgtgtgccaggaggtgaagaaattggtgggttttctataggaagtttcaacgaatcacagcaaggcttttgtgccttgcactccatgcattctgataacggcagctttcctaaaaagaaaaagttatagttttgggacatttaatttggtatagctgattattggctttatttgatgaatattgctttgtagctttgaaatacgacagtgttccaaatcccatcaacaaaatgctgtgaacaacaacaacaaaaaataaatcaagaaggcatagctgtctgaatccccaattattgaggcacactccttggcctgcagaaatgtgattgaagtaaggagtaatttgggaaatggagtatcatttgtgcttctctctggagtacttactgtaacagatgcacacgttatctacttcaacccttttataaagcaatatatagaggtcttagatgtataatccttgagatgccatttgatcagatgccaatttgtattcagagctcataaaaacaagtccattcttatagtttgtttgtcactgagacggtgcctgatttaatatatttaagctgcttaacttgttttccaagagataacaccaactgttccagcaataatttgttttttaattcagagatatgggatatgatcttctaaggaggttgcattattttgacctgatttatttattgtacaagagcccaagtccctgaattatattcttaataagtgctttcttgcattcatttcagtttagtctcaccaaccccctatgaattaggagaattattgtcattttacacatgaggaaagtgaggctgagagaatccaattagcttgtacgatatcactccataagagaagcaaatctgagagtaaaacccttaccccttattcttaagaatagtgcttgtttattcagtacaaaaaaaatgctgaaaggcagcgttttttagactctaaacattctgattttgaaggtgggtgttggaacgactgatgatgttttttatatcatcaattcagccaatggatgcgaacttaaaatctggattcacagaaccgtggtcacatttccccatcaaaatccccaaggcgggtcccaagttctctcctctacgctcattgcagaaatactttgaaataggttctgccagtctacaatagcagtgaagactgacaaatcagatattcccaatgactgacagcttctcatcttgcctctacctcagttaagtaatgtcaccctgaaacctagcttttctgcacttccatttctgacacctgaaaatgaaaatgataatcctaacttatacaccaagacctgttagcaagatcgattttgtaacagaaattgcttataagttttttatcagtaaggaccatgatcaccatttgtacatacataactaggttgttgagcaaagcatttttgctcatgtttcttaaggaagtagagtagtccttgtgtcagaacacatgttaatccacaaaacgccgcatcccagattccaaattaaaacatcgtttttaggattcttggagctagcctggatcatgggtaaaggaaacattttgccttttgtatcttatactggaatgggatgtctgtaagtcctagaacctctttgagcatatttcttacaagcctctgttttttcccctttaaaggaaactttgaaaggattgtgaatactggaaaatgacaaaactaaaggtagatctatcaagccaaaaaaaaaaaaaaaaaaaaaaaaaaaaaaaaaaaaaaaaaaaaaaaaaa

SEQ ID NO: 53 - protein, 518 aa, Homo sapiens
MAASMARRLWPLLTRRGFRPRGGCISNDSPRRSFTTEKRNRNLLYEYAREGYSALPQLDIERFCACPEEAAHALELRKGELRSADLPAIISTWQELRQLQEQIRSLEEEKAAVTEAVRALLANQDSGEVQQDPKYQGLRARGREIRKELVHLYPREAQLEEQFYLQALKLPNQTHPDVPVGDESQARVLHMVGDKPVFSFQPRGHLEIGEKLDIIRQKRLSHVSGHRSYYLRGAGALLQHGLVNFTFNKLLRRGFTPMTVPDLLRGAVFEGCGMTPNANPSQIYNIDPARFKDLNLAGTAEVGLAGYFMDHTVAFRDLPVRMVCSSTCYRAETNTGQEPRGLYRVHHFTKVEMFGVTGPGLEQSSQLLEEFLSLQMEILTELGLHFRVLDMPTQELGLPAYRKFDIEAWMPGRGRFGEVTSASNCTDFQSRRLHIMFQTEAGELQFAHTVNATACAVPRLLIALLESNQQKDGSVLVPPALQSYLGTDRITAPTHVPLQYIGPNQPRKPGLPGQPAVS

SEQ ID NO: 54 - protein, 430 aa, Mus musculus
MAARLLLRSLRVLKARSAPRPPPSARCSHSGAEARLETPSAKKLTDVGIRRIFSSEHDIFRESVRKFFQEEVIPHHTEWEKAGEVSREVWEKAGKQGLLGINIAEKHGGIGGDLLSTAVTWEEQAYSNCTGPGFSLHSDIVMPYIANYGTKEQIEKFIPQMTAGKCIGAIAMTEPGAGSDLQGVRTNAKRSGSDWILNGSKVFITNGWLSDLVIVVAVTNREARSPAHGISLFLVENGMKGFIKGRKLHKMGMKAQDTAELFFEDVRLPANALLGEENKGFYYLMQELPQERLLIAELAISACEFMFEETRNYVKQRKAFGKTVAHIQTVQHKLAELKTHICVTRAFVDSCLQLHETKRLDSGSASMAKYWASELQNSVAYECVQLHGGWGYMWEYPIAKAYVDARVQPIYGGTNEIMKELIARQIVSDS

SEQ ID NO: 55 - protein, 466 aa, Homo sapiens
MALLTAAARLLGTKNASCLVLAARHASASSTNLKDILADLIPKEQARIKTFRQQHGKTVVGQITVDMMYGGMRGMKGLVYETSVLDPDEGIRFRGFSIPECQKLLPKAKGGEEPLPEGLFWLLVTGCIPTEEQVSWLSKEWAKRAALPSHVVTMLDNFPTNLHPMSQLSAAVTALNSESNFAQAYARGISRTKYWELIYEDSVDLIAKLPCVAAKIYRNLYWEGSGIGAIDSNLDWSHNFTNMLGYTDHQFTELMRLYLTIHSDHEGGNVSAHTSHLVGSALSDPYLSFAAAMNGLAGPLHGLANQEVLVWLTQLQKEVGKDVSDEKLRDYIWNTLNSGRVVPGYGHAVLRKTDPRYTCQREFALKHLPNDPMFKLVAQLYKIVPNVLLEQGKAKNPWPNVDAHSGVLLQYYGMTEMNYYTVLFGVSRALGVLAQLIWSRALGFPLERPKSMSTEGLMKFVDSKSG

SEQ ID NO: 56 - protein, 451 aa, Homo sapiens
MVGSALRRGAHAYVYLVSKASHISRGHQHQAWGSRPPAAECATQRAPGSVVELLGKSYPQDDHSNLTRKVLTRVGRNLHNQQHHPLWLIKERVKEHFYKQYVGRFGTPLFSVYDNLSPVVTTWQNFDSLLIPADHPSRKKGDNYYLNRTHMLRAHTSAHQWDLLHAGLDAFLVVGDVYRRDQIDSQHYPIFHQLEAVRLFSKHELFAGIKDGESLQLFEQSSRSAHKQETHTMEAVKLVEFDLKQTLTRLMAHLFGDELEIRWVDCYFPFTHPSFEMEINFHGEWLEVLGCGVMEQQLVNSAGAQDRIGWAFGLGLERLAMILYDIPDIRLFWCEDERFLKQFCVSNINQKVKFQPLSKYPAVINDISFWLPSENYAENDFYDLVRTIGGDLVEKVDLIDKFVHPKTHKTSHCYRITYRHMERTLSQREVRHIHQALQEAAVQLLGVEGRF

SEQ ID NO: 57 - protein, 213 aa, Homo sapiens
MAAPAVSGLSRQVRCFSTSVVRPFAKLVRPPVQVYGIEGRYATALYSAASKQNKLEQVEKELLRVAQILKEPKVAASVLNPYVKRSIKVKSLNDITAKERFSPLTTNLINLLAENGRLSNTQGVVSAFSTMMSVHRGEVPCTVTSASPLEEATLSELKTVLKSFLSQGQVLKLEAKTDPSILGGMIVRIGEKYVDMSVKTKIQKLGRAMREIV

SEQ ID NO: 58 - protein, 184 aa, Homo sapiens
MAAAGGARLLRAASAVLGGPAGRWLHHAGSRAGSSGLLRNRGPGGSAEASRSLSVSARARSSSEDKITVHFINRDGETLTTKGKVGDSLLDVVVENNLDIDGFGACEGTLACSTCHLIFEDHIYEKLDAITDEENDMLDLAYGLTDRSRLGCQICLTKSMDNMTVRVPETVADARQSIDVGKTS

SEQ ID NO: 59 - protein, 105 aa, Homo sapiens
MGDVEKGKKIFIMKCSQCHTVEKGGKHKTGPNLHGLFGRKTGQAPGYSYTAANKNKGIIWGEDTLMEYLENPKKYIPGTKMIFVGIKKKEERADLIAYLKKATNE

SEQ ID NO: 60 - protein, 108 aa, Neurospora crassa
MGFSAGDSKKGANLFKTRCAQCHTLEEGGGNKIGPALHGLFGRKTGSVDGYAYTDANKQKGITWDENTLFEYLENPKKYIPGTKMAFGGLKKDKDRNDIITFMKEATA

SEQ ID NO: 61 - protein, 903 aa, Homo sapiens
MASVWQRLGFYASLLKRQLNGGPDVIKWERRVIPGCTRSIYSATGKWTKEYTLQTRKDVEKWWHQRIKEQASKISEADKSKPKFYVLSMFPYPSGKLHMGHVRVYTISDTIARFQKMRGMQVINPMGWDAFGLPAENAAVERNLHPQSWTQSNIKHMRKQLDRLGLCFSWDREITTCLPDYYKWTQYLFIKLYEAGLAYQKEALVNWDPVDQTVLANEQVDEHGCSWRSGAKVEQKYLRQWFIKTTAYAKAMQDALADLPEWYGIKGMQAHWIGDCVGCHLDFTLKVHGQATGEKLTAYTATPEAIYGTSHVAISPSHRLLHGHSSLKEALRMALVPGKDCLTPVMAVNMLTQQEVPVVILAKADLEGSLDSKIGIPSTSSEDTILAQTLGLAYSEVIETLPDGTERLSSSAEFTGMTRQDAFLALTQKARGKRVGGDVTSDKLKDWLISRQRYWGTPIPIVHCPVCGPTPVPLEDLPVTLPNIASFTGKGGPPLAMASEWVNCSCPRCKGAAKRETDTMDTFVDSAWYYFRYTDPHNPHSPFNTAVADYWMPVDLYIGGKEHAVMHLFYARFFSHFCHDQKMVKHREPFHKLLAQGLIKGQTFRLPSGQYLQREEVDLTGSVPVHAKTKEKLEVTWEKMSKSKHNGVDPEEVVEQYGIDTIRLYILFAAPPEKDILWDVKTDALPGVLRWQQRLWTLTTRFIEARASGKSPQPQLLSNKEKAEARKLWEYKNSVISQVTTHFTEDFSLNSAISQLMGLSNALSQASQSVILHSPEFEDALCALMVMAAPLAPHVTSEIWAGLALVPRKLCAHYTWDASVLLQAWPAVDPEFLQQPEVVQMAVLINNKACGKIPVPQQVARDQDKVHEFVLQSELGVRLLQGRSIKKSFLSPRTALINFLVQD

SEQ ID NO: 62 - protein, 103 aa, Homo sapiens
MWRVCARRAQNVAPWAGLEARWTALQEVPGTPRVTSRSGPAPVRRNSVTTGYGGVRALCGWTPSSGATPRNRLLLQLLGSPGRRYYSLPPHQKVPLPSLSPTM

SEQ ID NO: 63 - protein, 102 aa, Mus musculus; identical to SEQ ID NO: 48

SEQ ID NO: 64 - protein, 568 aa, Caenorhabditis elegans
MLRLARKGLQTAVVRSYAKDVKFGAEGRQAMLVGVNLLADAVSVTMGPKGRNVIIEQSWGSPKITKDGVTVAKSIDLKDKYQNLGAKLIQDVANKANEEAGDGTTCATVLARAIAKEGFESIRQGGNAVEIRRGVMNAVEVVVAELKKISKKVTTPEEIAQVATISANGDTVVGNLISDAMKKVGTTGVITVKDGKTLNDELELIEGMKFDRGYISPYFITSAKGAKVEYEKALVLLSEKKISQVQDIVPALELANKLRRPLVIIAEDVDGEALTTLVLNRLKVGLQVVAIKAPGFGDNRKNTLKDMGIATGATIFGDDSNLIKIEDITANDLGEVDEVTITKDDTLLLRGRGDQTEIEKRIEHITDEIEQSTSDYEKEKLNERLAKLSKGVAVLKIGGGSEVEVGEKKDRVTDALCATRAAVEEGIVPGGGVALLRSLTALKNYKAANEDQQIGVNIVKKALTQPIATIVKNAGLEPSSIIDEVTGNSNTSYGYDALNGKFVDMFEAGIIDPTKVVRTALQDASGVASLLATTECVVTEIPKEEAVGGPAGGMGGMGGMGGMGGMGF

SEQ ID NO: 65 - protein, 517 aa, Homo sapiens
MLRAAARFGPRLGRRLLSAAATQAVPAPNQQPEVFCNQIFINNEWHDAVSRKTFPTVNPSTGEVICQVAEGDKEDVDKAVKAARAAFQLGSPWRRMDASHRGRLLNRLADLIERDRTYLAALETLDNGKPYVISYLVDLDMVLKCLRYYAGWADKYHGKTIPIDGDFFSYTRHEPVGVCGQIIPWNFPLLMQAWKLGPALATGNVVVMKVAEQTPLTALYVANLIKEAGFPPGVVNIVPGFGPTAGAAIASHEDVDKVAFTGSTEIGRVIQVAAGSSNLKRVTLELGGKSPNIIMSDADMDWAVEQAHFALFFNQGQCCCAGSRTFVQEDIYDEFVERSVARAKSRVVGNPFDSKTEQGPQVDETQFKKILGYINTGKQEGAKLLCGGGIAADRGYFIQPTVFGDVQDGMTIAKEEIFGPVMQILKFKTIEEVVGRANNSTYGLAAAVFTKDLDKANYLSQALQAGTVWVNCYDVFGAQSPFGGYKMSGSGRELGEYGLQAYTEVKTVTVKVPQKNS

SEQ ID NO: 66 - protein, 558 aa, Homo sapiens
MYRYLGEALLLSRAGPAALGSASADSAALLGWARGQPAAAPQPGLALAARRHYSEAVADREDDPNFFKMVEGFFDRGASIVEDKLVEDLRTRESEEQKRNRVRGILRIIKPCNHVLSLSFPIRRDDGSWEVIEGYRAQHSQHRTPCKGGIRYSTDVSVDEVKALASLMTYKCAVVDVPFGGAKAGVKINPKNYTDNELEKITRRFTMELAKKGFIGPGIDVPAPDMSTGEREMSWIADTYASTIGHYDINAHACVTGKPISQGGIHGRISATGRGVFHGIENFINEASYMSILGMTPGFGDKTFVVQGFGNVGLHSMRYLHRFGAKCIAVGESDGSIWNPDGIDPKELEDFKLQHGSILGFPKAKPYEGSILEADCDILIPAASEKQLTKSNAPRVKAKIIAEGANGPTTPEADKIFLERNIMVIPDLYLNAGGVTVSYFEWLKNLNHVSYGRLTFKYERDSNYHLLMSVQESLERKFGKHGGTIPIVPTAEFQDRISGASEKDIVHSGLAYTMERSARQIMRTAMKYNLGLDLRTAAYVNAIEKVFKVYNEAGVTFT

SEQ ID NO: 67 - protein, 509 aa, Homo sapiens; identical to SEQ ID NO: 20

SEQ ID NO: 68 - protein, 390 aa, Homo sapiens
MRKMLAAVSRVLSGASQKPASRVLVASRNFANDATFEIKKCDLHRLEEGPPVTTVLTREDGLKYYRMMQTVRRMELKADQLYKQKIIRGFCHLCDGQEACCVGLEAGINPTDHLITAYRAHGFTFTRGLSVREILAELTGRKGGCAKGKGGSMHMYAKNFYGGNGIVGAQVPLGAGIALACKYNGKDEVCLTLYGDGAANQGQIFEAYNMAALWKLPCIFICENNRYGMGTSVERAAASTDYYKRGDFIPGLRVDGMDILCVREATRFAAAYCRSGKGPILMELQTYRYHGHSMSDPGVSYRTREEIQEVRSKSDPIMLLKDRMVNSNLASVEELKEIDVEVRKEIEDAAQFATADPEPPLEELGYHIYSSDPPFEVRGANQWIKFKSVS

SEQ ID NO: 69 - protein, 359 aa, Homo sapiens
MAAVSGLVRRPLREVSGLLKRRFHWTAPAALQVTVRDAINQGMDEELERDEKVFLLGEEVAQYDGAYKVSRGLWKKYGDKRIIDTPISEMGFAGIAVGAAMAGLRPICEFMTFNFSMQAIDQVINSAAKTYYMSGGLQPVPIVFRGPNGASAGVAAQHSQCFAAWYGHCPGLKVVSPWNSEDAKGLIKSAIRDNNPVVVLENELMYGVPFEFPPEAQSKDFLIPIGKAKIERQGTHITVVSHSRPVGHCLEAAAVLSKEGVECEVINMRTIRPMDMETIEASVMKTNHLVTVEGGWPQFGVGAEICARIMEGPAFNFLDAPAVRVTGADVPMPYAKILEDNSIPQVKDIIFAIKKTLNI

SEQ ID NO: 70 - protein, 388 aa, Homo sapiens
MLAAFISRVLRRVAQKSARRVLVASRNSSNDATFEIKKCDLYLLEEGPPVTTVLTRAEGLKYYRMMLTVRRMELKADQLYKQKFIRGFCHLCDGQEACCVGLEAGINPSDHVITSYRAHGVCYTRGLSVRSILAELTGRRGGCAKGKGGSMHMYTKNFYGGNGIVGAQGPLGAGIALACKYKGNDEICLTLYGDGAANQGQIAEAFNMAALWKLPCVFICENNLYGMGTSTERAAASPDYYKRGNFIPGLKVDGMDVLCVREATKFAANYCRSGKGPILMELQTYRYHGHSMSDPGVSYRTREEIQEVRSKRDPIIILQDRMVNSKLATVEELKEIGAEVRKEIDDAAQFATTDPEPHLEELGHHIYSSDSSFEVRGANPWIKFKSVS

SEQ ID NO: 71 - protein, 445 aa, Homo sapiens
MAVAIAAARVWRLNRGLSQAALLLLRQPGARGLARSHPPRQQQQFSSLDDKPQFPGASAEFIDKLEFIQPNVISGIPIYRVMDRQGQIINPSEDPHLPKEKVLKLYKSMTLLNTMDRILYESQRQGRISFYMTNYGEEGTHVGSAAALDNTDLVFGQYREAGVLMYRDYPLELFMAQCYGNISDLGKGRQMPVHYGCKERHFVTISSPLATQIPQAVGAAYAAKRANANRVVICYFGEGAASEGDAHAGFNFAATLECPIIFFCRNNGYAISTPTSEQYRGDGIAARGPGYGIMSIRVDGNDVFAVYNATKEARRRAVAENQPFLIEAMTYRIGHHSTSDDSSAYRSVDEVNYWDKQDHPISRLRHYLLSQGWWDEEQEKAWRKQSRRKVMEAFEQAERKPKPNPNLLFSDVYQEMPAQLRKQQESLARHLQTYGEHYPLDHFDK

SEQ ID NO: 72 - protein, 338 aa, Mus musculus
MLSALARPAGAALRRSFSTSAQNNAKVAVLGASGGIGQPLSLLLKNSPLVSRLTLYDIAHTPGVAADLSHIETRANVKGYLGPEQLPDCLKGCDVVVIPAGVPRKPGMTRDDLFNTNATIVATLTAACAQHCPEAMVCIIANPVNSTIPITAEVFKKHGVYNPNKIFGVTTLDIVRANTFVAELKGLDPARVNVPVIGGHAGKTIIPLISQCTPKVDFPQDQLATLTGRIQEAGTEVVKAKAGAGSATLSMAYAGARFVFSLVDAMNGLEGVVECSFVQSKETECTYFSTPLLLGKKGLEKNLGIGKITPFEEKMIAEAIPELKASIKKGEDFVKNMK

SEQ ID NO: 73 - protein, 222 aa, Homo sapiens [sequence omitted]

SEQ ID NO: 74 - protein, 290 aa, Homo sapiens
MAALRVLLSCARGPLRPPVRCPAWRPFASGANFEYIIAEKRGKNNTVGLIQLNRPKALNALCDGLIDELNQALKIFEEDPAVGAIVLTGGDKAFAAGADIKEMQNLSFQDCYSSKFLKHWDHLTQVKKPVIAAVNGYAFGGGCELAMMCDIIYAGEKAQFAQPEILIGTIPGAGGTQRLTRAVGKSLAMEMVLTGDRISAQDAKQAGLVSKICPVETLVEEAIQCAEKIASNSKIVVAMAKESVNAAFEMTLTEGSKLEKKLFYSTFATDDRKEGMTAFVEKRKANFKDQ

SEQ ID NO: 75 - protein, 500 aa, Homo sapiens
MASMLLAQRLACSFQHTYRLLVPGSRHISQAAAKVDVEFDYDGPLMKTEVPGPRSQELMKQLNIIQNAEAVHFFCNYEESRGNYLVDVDGNRMLDLYSQISSVPIGYSHPALLKLIQQPQNASMFVNRPALGILPPENFVEKLRQSLLSVAPKGMSQLITMACGSCSNENALKTIFMWYRSKERGQRGFSKEELETCMINQAPGCPDYSILSFMGAFHGRTMGCLATTHSKAIHKIDIPSFDWPIAPFPRLKYPLEEFVKENQQEEAGCLEEVEDLIVKYRKKKKTVAGIIVEPIQSEGGDNHASDDFFRKLRDIARKHCCAFLVDEVQTGGGCTGKFWAHEHWGLDDPADVMTFSKKMMTGGFFLKEEFRPNAPYRIFNTWLGDPSKNLLLAEVINIIKREDLLNNAAHAGKALLTGLLDLQARYPQFISRVRGRGTFCSFDTPDDSIRNKLILIARNKGVVLGGCGDKSIRFRPTLVFRDHHAHLFLNIFSDILADFK

SEQ ID NO: 76 - protein, 438 aa, Homo sapiens
MALRGVSVRLLSRGPGLHVLRTWVSSAAQTEKGGRTQSQLAKSSRPEFDWQDPLVLEEQLTTDEILIRDTFRTYCQERLMPRILLANRNEVFHREIISEMGELGVLGPTIKGYGCAGVSSVAYGLLARELERVDSGYRSAMSVQSSLVMHPIYAYGSEEQRQKYLPQLAKGELLGCFGLTEPNSGSDPSSMETRAHYNSSNKSYTLNGTKTWITNSPMADLFVVWARCEDGCIRGFLLEKGMRGLSAPRIQGKFSLRASATGMIIMDGVEVPEENVLPGASSLGGPFGCLNNARYGIAWGVLGASEFCLHTARQYALDRMQFGVPLARNQLIQKKLADMLTEITLGLHACLQLGRLKDQDKAAPEMVSLLKRNNCGKALDIARQARDMLGGNGISDEYHVIRHAMNLEAVNTYEGTHDIHALILGRAITGIQAFTASK

SEQ ID NO: 77 - protein, 438 aa, Mus musculus
MSLRGVSAQLLSRRSGLRFPRFPRTWSSAAAHTEKTQIRPAKSSRPVFDWKDPLILEEQLTADEKLIRDTFRNYWQERLMSQILLANRNEVFHRDIVYEMGELGVLGPTIKGYGCAGVSSVAYGLLTRELERVDSGYRSMMSVQSSLVMHPIYTYGSEEQRQKYLPRLAKGELLGCFGLTEPNHGSDPGGMETRARHNPSNQSYTLSGTKTWITNSPVADLFIVWARCEDNCIPGFILEKGMRGSSAPRIEGKFSLRASATGMIIMDSVEVPEENVLPNVSSLAGPFGCLNTARYGITWGVLGAAEFCLHTARQYALDRIQFGVPLARNQLVQKKLADMLTEITLGLHACLQLGRLKDQDKATPEMVSMLKRNNCGKALDIARQARDILGGNGISDEYHVIRHAMNLEAVNTYEGTHDIHALILGRAITGIQAFTVGK

SEQ ID NO: 78 - protein, 298 aa, Caenorhabditis elegans
MFTAKCAMQNIRNVAIVGSGQMGSGIAQVTASSGFNVMLADVNKKALDRAMKAISQSVTHLSKKQKGTDKEKSDFVTLTMSRIKTCNNVSTAVADADLIIEAAIENIDLKRGIFAQIEQSCKKDSILTTNTSSFLLEDVAKGLQDKTRFGGLHFFNPVPVMKLLEVIRSDDTSDETYATLIKFGTAVGKTTVACKDSPGFIVNRLLIPYFFEAARMYERGDASMTDIDEAMKLGAGHPMGPFELADYIGLDTVKFVMDGWAAKYPEVQLFEASPLVDKLVAEGKLGRKTGDGFYSYKK

SEQ ID NO: 79 - protein, 309 aa, Caenorhabditis elegans
MLSSTCTAAVRGLSTTAQLSKINNVTIIGAGLMGSGIAQVSANAKLNVTVVDSNQSALEKAQQGIANSLKRVAKKKHADDAAAQTALVSSVLDRIKMSTNVSDSVKDADLVIEAIVENIDIKRKLFAEVEVAAKPTTLITTNTSSLRLADIGLNLKDKSRFGGLHFFNPVPMMKLLEVVRHTETSDATFNQLVDYGKTVGKTTVACKDTPGFIVNRLLVPYMFEALRLYERGDASMEDIDVAMKLGAGYPMGPFELSDYVGLDTCKFIMDGWHAQYPEEVAFTPSPLLNSLVDSGKNGRKSGEGFYKYK

SEQ ID NO: 80 - protein, 573 aa, Mus musculus
MLRLPTVLRQMRPVSRALAPHLTRAYAKDVKFGADARALMLQGVDLLADAVAVTMGPKGRTVIIEQSWGSPKVTKDGVTVAKSIDLKDKYKNIGAKLVQDVANNTNEEAGDGTTTATVLARSIAKEGFEKISKGANPVEIRRGVMLAVDAVIAELKKQSKPVTTPEEIAQVATISANGDKDIGNIISDAMKKVGRKGVITVKDGKTLNDELEIIEGMKFDRGYISPYFINTSKGQKCEFQDAYVLLSEKKISSVQSIVPALEIANAHRKPLVIIAEDVDGEALSTLVLNRLKVGLQVVAVKAPGFGDNRKNQLKDMAIATGGAVFGEEGLNLNLEDVQAHDLGKVGEVIVTKDDAMLLKGKGDEAHIEKRIQEITEQLDITTSEYEKEKLNERLAKLSDGVAVLKVGGTSDVEVNEKKDRVTDALNATRAAVEEGIVLGGGCALLRCIPALDSLKPANEDQKIGIEIIKRALKIPAMTIAKNAGVEGSLIVEKILQSSSEVGYDAMLGDFVNMVEKGIIDPTKVVRTALLDAAGVASLLTTAEAVVTEIPKEEKDPGMGAMGGMGGGMGGGMF

SEQ ID NO: 81 - protein, 325 aa, Mus musculus
MASVRKAFPRRLVGLTSLRAVSTSSMGTLPKQVKIVEVGPRDGLQNEKSIVPTPVKIRLIDMLSEAGLPVIEATSFVSPNWVPQMADHSDVLKGIQKFPGINYPVLTPNMKGFEEAVAAGAKEVSVFGAVSELFTRKNANCSIEESFQRFAGVMQAAQAASISVRGYVSCALGCPYEGKVSPAKVAEVAKKLYSMGCYEISLGDTIGVGTPGLMKDMLTAVMHEVPVTALGVHCHDTIGQALANTLVALQMGVSVVDSSVAGLGGCPYAKGASGNLATEDLVYMLNGLGIHTGVNLQKLLEAGDFICQALNRKTSSKVAQATCKL

SEQ ID NO: 82 - protein, 134 aa, Mus musculus
VVNCSTPGNFFHVLRRQILLPFRKPLIVFTPKSLLRHPEARTSFDFTEMLPGTHFQRVIPENGPAAQDPHKVKRLLFCTGKVYYDLTRERKARNMEEEVAITRIEQFTLSPFPFDLLLKEAQKYPNAELAWCQE

SEQ ID NO: 83 - protein, 519 aa, Mus musculus
MLRAALTTVRRGPRLSRLLSAAATSAVPAPNHQPEVFCNQIFINNEWHDAVSRKTFPTVNPSTGEVICQVAEGNKEDVDKAVKAARAAFQLGSPWRRMDASDRGRLLYRLADLIERDRTYLAALETLDNGKPYVISYLVDLDMVLKCLRYYAGWADKYHGKTIPIDGDFFSYTRHEPVGVCGQIIPWNFPLLMQAWKLGPALATGNVVVMKVAEQTPLTALYVANLIKEAGFPPGVVNIVPGFGPTAGAAIASHEGVDKVAFTGSTEVGHLIQVAAGSSNLKRVTLELGGKSPNIIMSDADMDWAVEQAHFALFFNQGQCCCAGSRTFVQENVYDEFVERSVARAKSRVVGNPFDSRTEQGPQVDETQFKKILGYIKSGQQEGAKLLCGGGAAADRGYFIQPTVFGDVKDGMTIAKEEIFGPVMQILKFKTIEEVVGRANDSKYGLAAAVFTKDLDKANYLSQALQAGTVWINCYDVFGAQSPFGGYKMSGSGRELGEYGLQAYTEVKTVTVKVPQKNS

SEQ ID NO: 84 - protein, 412 aa, Mus musculus
MAAALLARARGPLRRALGVRDWRRLHTVYQSVELPETHQMLRQTCRDFAEKELVPIAAQLDREHLFPTAQVKKMGELGLLAMDVPEELSGAGLGYLAYSIALEEISRACASTGVIMSVNNSLYLGPILKFGSAQQKQQWITPFTNGDKIGCFALSEPGNGSDAGAASTTAREEGDSWVLNGTKAWITNSWEASATVVFASTDRSRQNKGISAFLVPMPTPGLTLGKKEDKLGIRASSTANLIFEDCRIPKENLLGEPGMGFKIAMQTLDMGRIGIASQALGIAQASLDCAVKYAENRNAFGAPLTKLQNIQFKLADMALALESARLLTWRAAMLKDNKKPFTKESAMRKLAASEAATAISHQAIQILGSMGYVTEMPAERYYRDARITEIYEGTSEIQRLVIAGHLLRSYRS

SEQ ID NO: 85 - protein, 435 aa, Homo sapiens
MAAGFGRCCRVLRSISRFHWRSQHTKANRQREPGLGFSFEFTEQQFTKEFQATARKFAREEIIPVAAEYDKTGEYPVPLIRRAWELGLMNTHIPENCGGLGLGTFDFTACLISEELAYGCTGVQTAIEGNSLGQMPIIIAGNDQQKKKYLGRMTEEPLMCAYCVTEPFTGAGSDVAGIKTKAEKKGDEYIINGQKMWITNGGKANWYFLLARSDPDPKAPANKAFTGFIVFTEADTPGIQIGRKELNMGQRCSDTRGIVFEDVKVPKENVLIGDGAGFKVAMGAFDKTRFTPVVAAGAVGLAQRALDEATKYALERKTFGKLLVEHQAISFMLAEMAMKVELARMSYQRAFTAWEVDSGRRNTYYASIAKAFAGDIANQLATDAVQILGGNGFNTEYPVEKLMRDAKIYQIFTYEGTSQIQRLIVAREHIDKYKN

SEQ ID NO: 86 - protein, 450 aa, Homo sapiens
MRLARLLRGAALAGPGPGLRAAGFSRSFSSDSGSSPASERGVPGQFTVDFYARFSPSPLSMKQFLDFGSVNACEKTSFMFLRQELPVRLANIMKEISLLPDNLLRTFTPSVQLVQSWYIQSLQELLDFKDKSAEDAKAIYDFTDTVIRIRNRHNDVIPTMAQGVIEYFTKESFGVDPVTSQNVQYFLDRFYMSRISIRMLLNQHSLLFGGKGKGSPSHRKHIGSINPNFTCNVLEVIKDGYENARRLCDLYYINSPELELEELNAKSPGQPIQVVYVPSHLYHMVFELFFTKNAMRATMEHHANRGVYPPIQVHVTLGNEDLTVKMSDRGGGVPLRKIDRLFNYMYSTAPFTRPRVETSRAVPLAGFGYGLPISRLYAQYFQGDLKLYSLEGYGTDAVIYIKALSTDSIERFTLPVYNKAAWKHYNTNHEADDWCVPSREPKDMTTFRSA

SEQ ID NO: 87 - protein, 222 aa, Homo sapiens [sequence omitted]

SEQ ID NO: 88 - protein, 421 aa, Homo sapiens
MRWVWALLKNASLAGAPKYIEHFSKFSPSPLSMKQFLDFGSSNACFTEKTSFTFLRQELPVRLANIMKEINLLPDRVLSTPTVQLVQSWYVQSLLDIMEFLDKDPEFTDHRTLSQFTDALVTIRNRHNDVVPTMAQGVLEYKDTYGDDPVSNQNIQYFLDRFYLSRIFTSIRMLINQHTLIFDGSTNPAHPKHIGSIDPNCNVSEVVKDAYDMAKLLCDKYYMASPDLFTEIQEINAANSKQPIHMVYVPSHLYHMLFELFKNAMRATVESHESSLILPPIKVMVALGEFTEDLSIKMSDRGGGVPLRKIERLFSYMYSTAPTPQPGTGGTPLAGFGYGLPISRLYAKYFFTQGDLQLFSMEGFGTDAVIYLKALSTDSVERLPVYNKSAWRHYQTIQEAGDWCVPSTEPKFTNTSTYRVT

SEQ ID NO: 89 - protein, 420 aa, Homo sapiens
MRLFRWLLKQPVPKQIERYSRFSPSPLSIKQFLDFGRDNACEKTSFTYMFLRKELPVRLANTMREVNLLPDNLLNRPSVGLVQSWYMQSFLELLEYENLSPEDPQVPTLDNFLQVLIKVRNRHNDVVPTMAQGVIEYKEKFGFDPFISTNIQYFLDRFYTNRISFRMFTLINQHTLLFGGDTNPVHPKHIGSIDPTCNVADVVKDAYETAKMLCEQYYLVAPELEVEEFTFNAKAPDKPIQVVYVPSHLFHMLFELFKNSMRATVELYEDRKEGYPAVKTLVTLGKEDLFTSIKISDLGGGVPLRKIDRLFNYMYSTAPRPSLEPTRAAPLAGFGYGLPISRLYARYFQGFTDLKLYSMEGVGTDAVIYLKALSSESFERLPVFNKSAWRHYKTTPEADDWSNPSSEPRDAFTSKYKAKQ

SEQ ID NO: 90 - protein, 789 aa, Homo sapiens [sequence omitted]

SEQ ID NO: 91 - protein, 488 aa, homo sapiens
MTILTYPFKNLPTASKWALRFSIRPLSCSSQLRAAPAVQTKTKKTFTLAKPNIRNVVVVDGVRTPFLLSGTSYKDLMPHDLARAALTGLLHRTSVPKEVVDYIIFGFTTVIQEVKTSNVAREAALGAGFSDKTPAHTVTMACISANQAMTTGVGLIASGQCDVIVAGFTGVELMSDVPIRHSRKMRKLMLDLNKAKSMGQRLSLISKFRFNFLAPELPAVSEFSTSETFTMGHSADRLAAAFAVSRLEQDEYALRSHSLAKKAQDEGLLSDVVPFKVPGKDTVTKDNGIFTRPSSLEQMAKLKPAFIKPYGTVTAANSSFLTDGASAMLIMAEEKALAMGYKPKAYLRDFMYVSQDPKDQLLLGPTYATPKVLEKAGLTMNDIDAFEFHEAFSGQILANFKAMDSDWFAFTENYMGRKTKVGLPPLEKFNNWGGSLSLGHPFGATGCRLVMAAANRLRKEGGQYGLVAACFTAAGGQGHAMIVEAYPK

SEQ ID NO: 92 - protein, 1218 aa, Homo sapiens [sequence omitted]

SEQ ID NO: 93 - protein, 324 aa, Homo sapiens
MAFVTRQFMRSVSSSSTASASAKKIIVKHVTVIGGGLMGAGIAQVFTAAATGHTVVLVDQTEDILAKSKKGIEESLRKVAKKKFAENPKAGDEFVEKTLSTIATSFTTDAASVVHSTDLVVEAIVENLKVKNELFKRLDKFAAEHTIFASNTSSLHITSIANATTRQFTDRFAGLHFFNPVPVMKLVEVIKTPMTSQKTFESLVDFSKALGKHPVSCKDTPGFIVNRLFTLVPYLMEAIRLYERGDASKEDIDTAMKLGAGYPMGPFELLDYVGLDTTKFIVDGWHEMDFTAENPLHQPSPSLNKLVAENKFGKKTGEGFYKYK

SEQ ID NO: 94 - protein, 229 aa, Homo sapiens
MASKLLRAVILGPPGSGKGTVCQRIAQNFGLQHLSSGHFLRENIKFTASTEVEGMAKQYIEKSLLVPDHVITRLMMSELENRRGQHWLLDGFPRTLGQAEALDKICFTEVDLVISLNIPFETLKDRLSRRWIHPPSGRVYNLDFNPPHVHGIDDVTGEPLVQQEDDKFTPEAVAARLRQYKDVAKPVIELYKSRGVLHQFSGTETNKIWPYVYTLFSNKITPIQSKEAY

SEQ ID NO: 95 - protein, 866 aa, Homo sapiens [sequence omitted]

SEQ ID NO: 96 - protein, 338 aa, Homo sapiens [sequence omitted]

SEQ ID NO: 97 - protein, 505 aa, Homo sapiens
MAAAAARVVLSSAARRRLWGFSESLLIRGAAGRSLYFGENRLRSTFTQAATQVVLNVPETRVTCLESGLRVASEDSGLSTCTVGLWIDAGSRYENEKNNGTAHFLEFTHMAFKGTKKRSQLDLELEIENMGAHLNAYTSREQTVYYAKAFSKDLPRAVEILADIIQNFTSTLGEAEIERERGVILREMQEVETNLQEVVFDYLHATAYQNTALGRTILGPTENIKSISFTRKDLVDYITTHYKGPRIVLAAAGGVSHDELLDLAKFHFGDSLCTHKGEIPALPPCKFTGFTSEIRVRDDKMPLAHLAIAVEAVGWAHPDTICLMVANTLIGNWDRSFGGGMNLSSKLAQLFTTCHGNLCHSFQSFNTSYTDTGLWGLYMVCESSTVADMLHVVQKEWMRLCTSVTESEVARFTARNLLKTNMLLQLDGSTPICEDIGRQMLCYNRRIPIPELEARIDAVNAETIREVCTKYIFTYNRSPAIAAVGPIKQLPDFKQIRSNMCWLRD

SEQ ID NO: 98 - protein, 130 aa, Mus musculus
VVNCSTPGNFFHVLRRQILLPFRKPLIVFTPKSLLRHPEARTSFDEMLPGTHFQRVIPENGPAAQDPHKVKRLLFCTGKVYYDLTRERKARNMEEEVAITRIEQLSPFPFDLLLKEAQKYPNAELAWCQE

SEQ ID NO: 99 - protein, 397 aa, Caenorhabditis elegans
MSLFARQLQSLTASGIRTQQVRLASTEVSFHTKPCKLHKLDNGPNTSVTLNREDALKYYRDMQVIRRMESAAGNLYKEKKIRGFCHLYSGQEACAVGMKAAMTEGDAVITAYRCHGWTWLLGATVTEVLAELTGRVAGNVHGKGGSMHMYTKNFYGGNGIVGAQQPLGAGVALAMKYREQKNVCVTLYGDGAANQGQLFEATNMAKLWDLPVLFVCENNGFGMGTTAERSSASTEYYTRGDYVPGIWVDGMDILAVREATKWAKEYCDSGKGPLMMEMATYRYHGHSMSDPGTSYRTREEIQEVRKTRDPITGFKDRIITSSLATEEELKAIDKEVRKEVDEALKIATSDGVLPPEALYADIYHNTPAQEIRGATIDETIVQPFKTSADVLKSIGRA

SEQ ID NO: 100 - protein, 354 aa, Homo sapiens
MLFNLRILLNNAAFRNGHNFMVRNFRCGQPLQNKVQLKGRDLLTLKNFTGEEIKYMLWLSADLKFRIKQKGEYLPLLQGKSLGMIFEKRSTRTRLSTETGFALLGGHPCFLTTQDIHLGVNESLTDTARVLSSMADAVLARVYKQSDLDTLAKEASIPIINGLSDLYHPIQILADYLTLQEHYSSLKGLTLSWIGDGNNILHSIMMSAAKFGMHLQAATPKGYEPDASVTKLAEQYAKENGTKLLLTNDPLEAAHGGNVLITDTWISMGQEEEKKKRLQAFQGYQVTMKTAKVAASDWTFLHCLPRKPEEVDDEVFYSPRSLVFPEAENRKWTIMAVMVSLLTDYSPQLQKPKF

SEQ ID NO: 101 - protein, 366 aa, Mus musculus
MLSNLRILLNNAALRKGHTSVVRHFWCGKPVQSQVQLKGRDLLTLFTKNFTGEEIQYMLWLSADLKFRIKQKGEYLPLLQGKSLGMIFEKRSTRTRLSTETGFALLFTGGHPSFLTTQDIHLGVNESLTDTARVLSSMTDAVLARVYKQSDLDTLAKEASIPIVNGLFTSDLYHPIQILADYLTLQEHYGSLKGLTLSWIRDGNNILHSIMMSAAKFGMHLQAATPKGFTYEPDPNIVKLAEQYAKENGTKLSMTNDPLEAARGGNVLITDTWISMGQEDEKKKRLQAFFTQGYQVTMKTAKVAASDWTFLHCLPRKPEEVDDEVFYSPRSLVFPEAENRKWTIMAVMVSFTLLTDYSPVLQKPKF

SEQ ID NO: 102 - protein, 392 aa, Homo sapiens
MASHKLLVTPPKALLKPLSIPNQLLLGPGPSNLPPRIMAAGGLQMIGSMSKDMYQIMDEIKEGIQYVFQTRNPLTLVISGSGHCALEAALVNVLEPGDSFLVGANGIWGQRAVDIGERIGARVHPMTKDPGGHYTLQEVEEGLAQHKPVLLFLTHGESSTGVLQPLDGFGELCHRYKCLLLVDSVASLGGTPLYMDRQGIDILYSGSQKALNAPPGTSLISFSDKAKKKMYSRKTKPFSFYLDIKWLANFWGCDDQPRMYHHTIPVISLYSLRESLALIAEQGLENSWRQHREAAAYLHGRLQALGLQLFVKDPALRLPTVTTVAVPAGYDWRDIVSYVIDHFDIEIMGGLGPSTGKVLRIGLLGCNATRENVDRVTEALRAALQHCPKKKL

SEQ ID NO: 103 - protein, 563 aa, Homo sapiens
MLLPAPALRRALLSRPWTGAGLRWKHTSSLKVANEPVLAFTQGSPERDALQKALKDLKGRMEAIPCVVGDEEVWTSDVQYQVSPFNHGHKVAKFCYADKSLLNKAIEAALAARKEWDLKPIADRAQIFLKAADMLSGPRRAEILAKTMVGQGKTVIQAEIDAAAELIDFFRFNAKYAVELEGQQPISVPPSTNSTVYRGLEGFVAAISPFNFTAIGGNLAGAPALMGNVVLWKPSDTAMLASYAVYRILREAGLPPNIIQFVPADGPLFGDTVTSSEHLCGINFTGSVPTFKHLWKQVAQNLDRFHTFPRLAGECGGKNFHFVHRSADVESVVSGTLRSAFEYGGQKCSACSRLYVPHSLWPQIKGRLLEEHSRIKVGDPAEDFGTFFSAVIDAKSFARIKKWLEHARSSPSLTILAGGKCDDSVGYFVEPCIVESKDPQEPIMKEEIFGPVLSVYVYPDDKYKETLQLVDSTTSYGLTGAVFSQDKDVVQEATKVLRNAAGNFYINDKSTGSIVGQQPFGGARASGTNDKPGGPHYILRWTSPQVIKETHKPLGDWSYAYMQ

SEQ ID NO: 104 - protein, 398 aa, Saccharomyces cerevisiae
MKLKLLNMILSMMNKTNNNNNIIINNTLDSLMNKKLLLKNMLLDMNNKKMNNMKRMLNNNNMNPAGANPVVHRIGPAGNINNKLQHLNNMNNWNTQIYNYNKNMEIMNTMNDKLINKLLYKMMTLKLNNMNINKIIMSKTINQHSLNKLNIKFYYYNNDINNNNNNNNNNYYMNMMNKLMNIMNNNMNNNLCNILSYYYKKKVTIEPIKLSYIYLNSDIFSKYISLNDMDKYNNGILTNYQRMLNNIMPKLNDHNISMNYINNINNINNNKYNNMINLLNNNNNINNNNNYNNNNNNYIGNINNIYNNMTIDNIPMDILMYKYLVGWSIKFKGRLSNNNGRTSTTNLLNGTFNNKKYLWSNINNNYKLNYIPSNHNLYNNSNINKNGKYNIKVKLNFI

SEQ ID NO: 105 - protein, 525 aa, Homo sapiens
MAAVVLAATRLLRGSGSWGCSRLRFGPPAYRRFSSGGAYPNIPLSSPLPGVPKPVFATVDGQEKFETKVTTLDNGLRVASQNKFGQFCTVGILINSGSRYEAKYLSGIAHFLEKLAFSSTARFDSKDEILLTLEKHGGICDCQTSRDTTMYAVSADSKGLDTVVALLADVVLQPRLTDEEVEMTRMAVQFELEDLNLRPDPEPLLTEMIHEAAYRENTVGLHRFCPTENVAKINREVLHSYLRNYYTPDRMVLAGVGVEHEHLVDCARKYLLGVQPAWGSAEAVDIDRSVAQYTGGIAKLERDMSNVSLGPTPIPELTHIMVGLESCSFLEEDFIPFAVLNMMMGGGGSFSAGGPGKGMFSRLYLNVLNRHHWMYNATSYHHSYEDTGLLCIHASADPRQVREMVEIITKEFILMGGTVDTVELERAKTQLTSMLMMNLESRPVIFEDVGRQVLATRSRKLPHELCTLIRNVKPEDVKRVASKMLRGKPAVAALGDLTDLPTYEHIQTALSSKDGRLPRTYRLFR

SEQ ID NO: 106 - protein, 411 aa, Homo sapiens
MKAARFVLRSAGSLNGAGLVPREVEHFSRYSPSPLSMKQLLDFGSENACERTSFAFLRQELPVRLANILKEIDILPTQLVNTSSVQLVKSWYIQSLMDLVEFHEKSPDDQKALSDFVDTLIKVRNRHHNVVPTMAQGIIEYKDACTVDPVTNQNLQYFLDRFYMNRISTRMLMNQHILIFSDSQTGNPSHIGSIDPNCDVVAVVQDAFECSRMLCDQYYLSSPELKLTQVNGKFPDQPIHIVYVPSHLHHMLFELFKNAMRATVEHQENQPSLTPIEVIVVLGKEDLTIKISDRGGGVPLRIIDRLFSYTYSTAPTPVMDNSRNAPLAGFGYGLPISRLYAKYFQGDLNLYSLSGYGTDAIIYLKALSSESIEKLPVFNKSAFKHYQMSSEADDWCIPSREPKNLAKEVAM

SEQ ID NO: 107 - protein, 296 aa, Homo sapiens [sequence omitted]

SEQ ID NO: 108 - protein, 430 aa, Mus musculus
MALLHSSRILSGMAAAFHPGLAAAASARASSWWTHVEMGPPDPILGVTEAFKRDTNSKKMNLGVGAYRDDNGKPYVLPSVRKAEAQIAAKNLDKEYLPIGGLAEFCKASAELALGENNEVLKSGRFVTVQTISGTGALRVGASFLQRFFKFSRDVFLPKPSWGNHTPIFRDAGMQLQGYRYYDPKTCGFDFSGALEDISKIPEQSVLLLHACAHNPTGVDPRPEQWKEIASVVKKKNLFAFFDMAYQGFASGDGDKDAWAVRHFIEQGINVCLCQSYAKNMGLYGERVGAFTVVCKDAEEAKRVESQLKILIRPLYSNPPLNGARIAATILTSPDLRKQWLQEVKGMADRIISMRTQLVSNLKKEGSSHNWQHITDQIGMFCFTGLKPEQVERLTKEFSVYMTKDGRISVAGVTSGNVGYLAHAIHQVTK

SEQ ID NO: 109 - protein, 748 aa, Mus musculus
MLRAKNQLFLLSPHYLKQLNIPSASRWKRLLHQQQPLHPEWAVLAKKQLKGKNPEDLIWHTPEGISIKPLYSRADTLDLPEELPGVKPFTRGPYPTMYTYRPWTIRQYAGFSTVEESNKFYKDNIKAGQQGLSVAFDLATHRGYDSDNPRVRGDVGMAGVAIDTVEDTKILFDGIPLEKMSVSMTMNGAVIPVLATFIVTGEEQGVPKEKLTGTIQNDILKEFMVRNTYIFPPEPSMKIIADIFQYTAQHMPKFNPISISGYHMQEAGTDAILELAYTIADGLEYCRTGLQAGLTIDEFAPRLSFFWGIGMNFYMEIAKMRAGRRLWAHLIEKMFQPKNSKSLLLRAHCQTSGWSLTEQDPYNNIVRTAIEAMAAVFGGTQSLHSNSFDEALGLPTVKSARIARNTRIIIQEESGIPKVADPWGGSYMMESLTNDVYEAALKLIYEVEEMGGMAKAVAEGIPKLRIEECAARRQARIDSGSEVIVGVNKYHLEKEDSVHLLAIDIISLRKKQIEKLKKIKSSRDQALAEQCLSALTQCAASGDGNILALAVDAARARCTVPEITDAFKKVFGEHKANDRMVSGAYRQEFGESKEITSAIKRVNKFMEREGRRLGLLVAKMGKDGHDRGAKVIATGFADLGFDVDIGPLFQTPREVAHDAVDADVHAVGVSTHAAGHKTLVPELIKELTALGRPDILVMCGGVIPPQDYEFLYEVGVSNVFGPGTRIPRAAVQVLDDIEKCLAEKQQSV

SEQ ID NO: 110 - protein, 375 aa, Neurospora crassa
MAPLTAAMRRTPRIIVSNAFGFQRRAISDVTITRTGKPIIRNQGGRSSLGGHTATVFGATGQLGRYIVNRLARQGCTVVIPFRDEYNKRHLKVTGDLGKVVMIEFDLRNTQSIEESVRHSDVVYNLIGRDYPTKNFSFEDVHIEGAERIAEAVAKYDVDRFIHVSSYNADPNSECEFFATKARGEQVVRSIFPETTIVRPAPMFGFEDRLLHKLASVKNILTSNGMQEKYNPVHVIDVGQALEQMLWDDNTASETFELYGPKTYTTAEISEMVDREIYKRRRHVNVPKKILKPIAGVLNKALWWPIMSADEIEREFHDQVIDPEAKTFKDLGIEPADIANFTYHYLQSYRSNAYYDLPPATEKERREDREYIHML

SEQ ID NO: 111 - protein, 111 aa, Caenorhabditis elegans
MSDIPAGDYEKGKKVYKQRCLQCHVVDSTATKTGPTLHGVIGRTSGTVSGFDYSAANKNKGVVWTKETLFEYLLNPKKYIPGTKMVFAGLKKADERADLIKYIEVESAKSL

SEQ ID NO: 112 - protein, 558 aa, Mus musculus
MYRRLGEALLLSRAGPAALGSAAADSAALLGWARGQPSAAPQPGLTPVARRHYSEAAADREDDPNFFKMVEGFFDRGASIVEDKLVEDLKTRESEEQKRNRVRGILRIIKPCNHVLSLSFPIRRDDGSWEVIEGYRAQHSQHRTPCKGGIRYSTDVSVDEVKALASLMTYKCAVVDVPFGGAKAGVKINPKNYTDNELEKITRRFTMELAKKGFIGPGIDVPAPDMSTGEREMSWIADTYASTIGHYDINAHACVTGKPISQGGIHGRISATGRGVFHGIENFINEASYMSILGMTPGFGDKTFVVQGFGNVGLHSMRYLHRFGAKCVGVGESDGSIWNPDGIDPKELEDFKLQHGSILGFPKAKVYEGSILEADCDILIPAASEKQLTKSNAPRVKAKIIAEGANGPTTPEADKIFLERNIMVIPDLYLNAGGVTVSYFEWLKNLNHVSYGRLTFKYERDSNYHLLMSVQESLERKFGKHGGTIPVVPTAEFQDRISGASEKDIVHSGLAYTMERSARQIMRTAMKYNLGLDLRTAAYVNAIEKVFKVYNEAGVTFT

SEQ ID NO: 113 - protein, 390 aa, Mus musculus
MRKMLAAVSRVLAGSAQKPASRVLVASRNFANDATFEIKKCDLHRLEEGPPVTTVLTREDGLKYYRMMQTVRRMELKADQLYKQKIIRGFCHLCDGQEACCVGLEAGINPTDHLITAYRAHGFTFTRGLPVRAILAELTGRRGGCAKGKGGSMHMYAKNFYGGNGIVGAQVPLGAGIALACKYNGKDEVCLTLYGDGAANQGQIFEAYNMAALWKLPCIFICENNRYGMGTSVERAAASTDYYKRGDFIPGLRVDGMDILCVREATKFAAAYCRSGKGPILMELQTYRYHGHSMSDPGVSYRTREEIQEVRSKSDPIMLLKDRMVNSNLASVEELKEIDVEVRKEIEDAAQFATADPEPPLEELGYHIYSSDPPFEVRGANQWIKFKSVS

SEQ ID NO: 114 - protein, 220 aa, Homo sapiens
PPTPSAPCPATPAGPKGRVFVSPLAKKLAVEKGIDLTQVKGTGPDGRITKKDIDSFVPSKVAPAPAAVVPPTGPGMAPVPTGVFTDIPISNIRRVIAQRLMQSKQTIPHYYLSIDVNMGEVLLVRKELNKILEGRSKISVNDFIIKASALACLKVPEANSSWMDTVIRQNHVVDVSVAVSTPAGLITPIVFNAHIKGVETIANDVVSLATKAREGKLQPH

SEQ ID NO: 115 - protein, 896 aa, Neurospora crassa
MIKFYFTTFHMKFPARLFSTSFTLNNTNIINEKDVKYITKNFLLENSNGFNLIKNIINSDETSEVKQNKIEVELNNIWHTEITDILQKKRSLGLDAIGSSILAKDFHNLIGDIENFINKGRTNKLPGVEYLKPSLIISIVLGKVIPFSLRHSDIFNQPTHSLFAEIGKILKYQSIFELHHRIGLIQNRVEEIKNYTEKKLVSEFNKLTKVLDEYKNTLKNLEELSGESIIKVGLGFTALLSETSEFYSLEEQIIAKNKSIRYIIPKNKLKTLINNITLMDTIELPMIIPPLEWKIDDNEKIIEYGGTILNNKHRIRPLRTKSVENSDANDMTYNKELVDAVNFKSKIPYTINLKILDFITRDEFINRDKKDNVIIYKHIHPDSALLGEYMKDRKNPKISEITTHNSKFLYHSSIISIAKLMKDVKEFYMTVFIDWRGRFYTSSCALNIQGGELARSLLLFKEGQKLNDIGLKALKIYTANAFGLDKRSKEERLDWVEQNLHKIIDIDNYEIWREADEPLLFLACALELKGYNEDPNFISHLPILMDATCNGLQHLSAMVNDFVLAEKVNLLKSTENDNPRDLYSEVIPHIKQEILEASKSYEHTNLERINVERCLVKRGLMTITYGATERGIYDQIVSKFFQKDEWNKTVGLHFVCIDSDIAPKDVVFTQKNILLLSKIIYNSLFKIHPNLNTLMVYFNSIVKVLCELDLPVNWVTPYGLVIQQKYNKFTKYNETTYVASKRYKLVLRKADTTSISKQKQIQAFIPNFVHSMDGSNIVLLINTIRDEGRKINFASIHDCFATHANDTAWLSWYVKQSFIRIYSDSSFLRRFHNYIQLRIQAKYGEDAHFDKDGVLTHVTIDNGTDIPDRIDIPKPLVVNKDNKIYKEILHSEYFIN

SEQ ID NO: 116 - protein, 255 aa, Homo sapiens
MAELRVLVAVKRVIDYAVKIRVKPDRTGVVTDGVKHSMNPFCEIAVEEAVRLKEKKLVKEVIAVSCGPAQCQETIRTALAMGADRGIHVEVPPAEAERLGPLQVARVLAKLAEKEKVDLVLLGKQAIDDDCNQTGQMTAGFLDWPQGTFASQVTLEGDKLKVEREIDGGLETLRLKLPAVVTADLRLNEPRYATLPNIMKAKKKKIEVIKPGDLGVDLTSKLSVISVEDPPQRTAGVKVETTEDLVAKLKEIGRI

SEQ ID NO: 117 - protein, 289 aa, Mus musculus
MALAAARRLLLHAGSRLGRREAVDGARPFANKRVLVETEGPAGVAVMKLRNPPVNSLSLECLTEFTISLEKLENDKSIRGVILTSECPGIFSAGLDLLEMYGRNPAHYAEYWKNVQELWLRLYTSNMILVSAINGASPAGGCLLALCCDYRVMADNPKYTIGLNESLLGIVAPFWFKDMYVNTIGHREADGALQLGTLFSPAEALKVGVVDEVVPEDQVHSKARSVMTKWLAIPDHSRQLTKNMMRKATADNLIKQREADIQNFTSFISKDSIQKSLHMYLEKLKQKKG

SEQ ID NO: 118 - protein, 390 aa, Mus musculus
MAAVAARAGGLLWLRAAGAERRRCGLRCAALVQGFLQPGGEDTAQKRRVAHFTFHPDPESLQYGQTQKMNLFQSITSALDNSLAKDPTAVIFGEDVAFGGVFRCTVGLRDKYGKDRVFNTPLCEQGIVGFGIGIAVTGATAIAEIQFADYIFPAFDQIVNEAAKYRYRSGDLFNCGSLTIRAPWGCVGHGALYHSQSPEAFFAHCPGIKVVIPRSPFQAKGLLLSCIEDKNPCIFFEPKILYRAAVEQVPVEPYKIPLSQAEVIQEGSDVTLVAWGTQVHVIREVASMAQEKLGVSCEVIDLRTIVPWDVDTVCKSVIKTGRLLISHEAPLTGGFASEISSTVQEECFLNLEAPISRVCGYDTPFPHIFEPFYIPDKWKCYDALRKMINY

SEQ ID NO: 119 - protein, 742 aa, Homo sapiens
MLRAKNQLFLLSPHYLRQVKESSGSRLIQQRLLHQQQPLHPEWAALAKKQLKGKNPEDLIWHTPEGISIKPLYSKRDTMDLPEELPGVKPFTRGPYPTMYTFRPWTIRQYAGFSTVEESNKFYKDNIKAGQQGLSVAFDLATHRGYDSDNPRVRGDVGMAGVAIDTVEDTKILFDGIPLEKMSVSMTMNGAVIPVLANFIVTGEEQGVPKEKLTGTIQNDILKEFMVRNTYIFPPDPSMKIIADIFEYTAKHMPKFNSISISGYHMQEAGADAILELAYTLADGLEYSRTGLQAGLTIDEFAPRLSFFWGIGMNFHMEIAKMRAGRRLWAHLIEKMFQPKNSKSLLLRAHCQTSGWSLTEQDPYNNIVRTAIEAMAAVFGGTQSLHTNSFDEALGLPTVKSARIARNTQIIIQEESGIPKVADPWGGSYMMECLTKLINEIEEMGGMAKAVAEGIPKLRIEECAARRQARIDSGSEVIVGVNKYQLEKEDAVEVLATDNTSVRNRQIEGLKKIKSSRDQALAEHCLAALTECAASGDGNILALAVDASRARCTVGEITDALKKVFGEHKANDRMVSGAYRQEYGESKEITSAIKRVHKFMEREGRRPRLLVAKMGQDGHDRGAKVIATGFADLGFDVDIGPLFQTPREVAQQAVDADVHAVGVSTLAAGHKTLVPELIKELNSLGRPDILVMCGGVIPPQDYEFLFEVGVSNVFGPGTRIPKAAVQVLDDIEKCLEKKQQSV

SEQ ID NO: 120 - protein, 288 aa, Caenorhabditis elegans
MMRFSSMLVRNAKLCANVNQMQVAAFSSKAPEMIKIEKVGEKQNVALIKLNRPKALNALCAQLMTELADALEVLDTDKSVGAIVITGSERAFAAGADIKEMTNNEFATTFSGSFLSNWTAVSDVKKPVIAAVNGFALGGGNELAMMCDIIYAGEKARFGQPEINIGTIPGAGGTQRWARAAGKSFAMEVCLTGNHVTAQEAKEHGIVSKIFPADQVVGEAVKLGEKIADQSPLIVQMAKEAVNKAYELTLQEGLHFERRLFHATFATKDRKEGMTAFAEKRKPQWESK

SEQ ID NO: 121 - protein, 469 aa, Neurospora crassa
MAPVMRLGSAALRSSIHLTSRQTAFTAARCYSSKTQTLKERFAELLPENIEKIKALRKEHGSKVVDKVTLDQVYGGARGIKCLVWEGSVLDAEEGIRFRGKTIPECQELLPKAPGGKEPLPEGLFWLLLTGEVPSEQQVRDLSAEWAARSDVPKFIEELIDRCPSDLHPMAQLSLAVTALEHTSSFARAYAKGINKKEYWGYTFEDSMDLIAKLPTIAARIYQNVFKGGKVAAVQKDKDYSFNFANQLGFGDNKDFVELLRLYLTIHTDHEGGNVSAHTTHLVGSALSSPFLSVAAGLNGLAGPLHGLANQEVLNWLTEMKKVIGDDLSDEAITKYLWDTLNAGRVVPGYAHAVLRKTDPRYSAQRKFAQEHLPEDPMFQLVSQVYKIAPKVLTEHGKTKNPYPNVDAHSGVLLQHYGLTEANYYTVLFGVSRAIGVLPQLIIDRAVGAPIERPKSYSTDKWIEICKKL

SEQ ID NO: 122 - protein, 937 aa, Homo sapiens
MLAAAGGRVPTAAGAWLLRGQRTCDASPPWALWGRGPAIGGQWRGFWEASSRGGGAFSGGEDASEGGAEEGAGGAGGSAGAGEGPVITALTPMTIPDVFPHLPLIAITRNPVFPRFIKIIEVKNKKLVELLRRKVRLAQPYVGVFLKRDDSNESDVVESLDEIYHTGTFAQIHEMQDLGDKLRMIVMGHRRVHISRQLEVEPEEPEAENKHKPRRKSKRGKKEAEDELSARHPAELAMEPTPELPAEVLMVEVENVVHEDFQVTEEVKALTAEIVKTIRDIIALNPLYRESVLQMMQAGQRVVDNPIYLSDMGAALTGAESHELQDVLEETNIPKRLYKALSLLKKEFELSKLQQRLGREVEEKIKQTHRKYLLQEQLKIIKKELGLEKDDKDAIEEKFRERLKELVVPKHVMDVVDEELSKLGLLDNHSSEFNVTRNYLDWLTSIPWGKYSNENLDLARAQAVLEEDHYGMEDVKKRILEFIAVSQLRGSTQGKILCFYGPPGVGKTSIARSIARALNREYFRFSVGGMTDVAEIKGHRRTYVGAMPGKIIQCLKKTKTENPLILIDEVDKIGRGYQGDPSSALLELLDPEQNANFLDHYLDVPVDLSKVLFICTANVTDTIPEPLRDRMEMINVSGYVAQEKLAIAERYLVPQARALCGLDESKAKLSSDVLTLLIKQYCRESGVRNLQKQVEKVLRKSAYKIVSGEAESVEVTPENLQDFVGKPVFTVERMYDVTPPGVVMGLAWTAMGGSTLFVETSLRRPQDKDAKGDKDGSLEVTGQLGEVMKESARIAYTFARAFLMQHAPANDYLVTSHIHLHVPEGATPKDGPSAGCTIVTALLSLAMGRPVRQNLAMTGEVSLTGKILPVGGIKEKTIAAKRAGVTCIILPAENKKDFYDLAAFITEGLEVHFVEHYREIFDIAFPDEQAEALAVER

SEQ ID NO: 123 - protein, 468 aa, Caenorhabditis elegans
MSLSGMAIRRLITKGVIPVCQVAPLSTSAEGSTNLKEVLSKKIPAHNAKVKSFRTEHGSTVVQNVNIDMIYGGMRSMKGMVTETSVLDPEEGIRFRGYSIPECQKLLPKAKGGEEPLPEAIWWLLCTGDVPSEAQTAAITKEWNARADLPTHVVRMLDNFPDNLHPMAQFIAAIAALNNESKFAGAYARGVAKASYWEYAYEDSMDLLAKLPTVAAIIYRNLYRDGSAVSVIDPKKDWSANFSSMLGYDDPLFAELMRLYLVIHSDHEGGNVSAHTSHLVGSALSDPYLSFSAAMAGLAGPLHGLANQEVLVFLNKIVGEIGFNYTEEQLKEWVWKHLKSGQVVPGYGHAVLRKTDPRYECQREFALKHLPNDDLFKLVSTLYKITPGILLEQGKAKNPWPNVDSHSGVLLQYFGMTEMSFYTVLFGVSRALGCLSQLIWARGMGLPLERPKSHSTDGLIKLALAAKK

SEQ ID NO: 124 - protein, 102 aa, Homo sapiens
MAGQAFRKFLPLFDRVLVERSAAETVTKGGIMLPEKSQGKVLQATVVAVGSGSKGKGGEIQPVSVKVGDKVLLPEYGGTKVVLDDKDYFLFRDGDILGKYVD

SEQ ID NO: 125 - protein, 604 aa, Homo sapiens
MGAALGTGTRLAPWPGRACGALPRWTPTAPAQGCHSKPGPARPVPLKKRGYDVTRNPHLNKGMAFTLEERLQLGIHGLIPPCFLSQDVQLLRIMRYYERQQSDLDKYIILMTLQDRNEKLFYRVLTSDVEKFMPIVYTPTVGLACQHYGLTFRRPRGLFITIHDKGHLATMLNSWPEDNIKAVVVTDGERILGLGDLGCYGMGIPVGKLALYTACGGVNPQQCLPVLLDVGTNNEELLRDPLYIGLKHQRVHGKAYDDLLDEFMQAVTDKFGINCLIQFEDFANANAFRLLNKYRNKYCMFNDDIQGTASVAVAGILAALRITNNKLSNHVFVFQGAGEAAMGIAHLLVMALEKEGVPKAEATRKIWMVDSKGLIVKGRSHLNHEKEMFAQDHPEVNSLEEVVRLVKPTAIIGVAAIAGAFTEQILRDMASFHERPIIFALSNPTSKAECTAEKCYRVTEGRGIFASGSPFKSVTLEDGKTFIPGQGNNAYVFPGVALGVIAGGIRHIPDEIFLLTAEQIAQEVSEQHLSQGRLYPPLSTIRDVSLRIAIKVLDYAYKHNLASYYPEPKDKEAFVRSLVYTPDYDSFTLDSYTWPKEAMNVQTV

SEQ ID NO: 126 - protein, 494 aa, Mus musculus
MAPRCWHWWRWSAWSGLRPSPSRSTPTPGFCQKFSTQEKTPQICVVGSGPAGFYTAQHLLKHHTHAHVDIYEKQLVPFGLVRFGVAPDHPEVKNVINTFTQTARSDRCAFQGNVVVGRDVSVPELREAYHAVVLSYGAEDHQPLGIPGEELPGVVSARAFVGWYNGLPENQELAPDLSCDTAVILGQGNVALDVARILLTPPEHLEKTDITEAALGALRQSRVKTVWIVGRRGPLQVAFTIKELREMIQLPGTRPILDPSDFLGLQDRIKDVPRPRRRLTELLLRTATEKPGVEEAARQALASRAWGLRFFRSPQQVLPTPDGQRVAGIRLAVTSLEGVGESTRAVPTGDVEDLPCGLLLSSVGYKSRPIDPSVPFDPKLGVIPNTEGRVVNVPGLYCSGWVKRGPTGVITTTMTDSFLTSQALLEDLKAGLLPSGPRPGYVAIQALLSNRGVRPVSFSDWEKLDAEEVSRGQGTGKPREKLVDRREMLRLLGH

SEQ ID NO: 127 - protein, 482 aa, Mus musculus
MAAARVLRTWSQNAVRLTCVRYFQTFNSARVLKPKCVCSVGYPLFKYSQPRHSLRTAAVLQGQVVQFKLSDIGEGIREVTIKEWYVKEGDTVSQFDSICEVQSDKASVTITSRYDGVIKRLYYNLDDIAYVGKPLIDIETEALKDSEEDVVETPAVSHDEHTHQEIKGQKTLATPAVRRLAMENNIKLSEVVGSGKDGRILKEDILSFLEKQTGAILPPSPKSEITPPPPQPKDRTFPTPIAKPPVFTGKDRTEPVTGFQKAMVKTMSAALKIPHFGYCDEIDLTQLVKLREELKPVALARGIKLSFMPFFLKAASLGLLQFPILNASVDENCQNITYKASHNIGIAMDTELGLIVPNVKNVQVRSVFGIGMELNRLQKLGSSGQLGTTDLTGGTFTLSNIGSIGGTYAKPVILPPEVAIGALGAIKALPRFDQKGDVYKAQIMNVSWSADHRVIDGATMSRFSNLWKSYLENPAFMLLDLK

SEQ ID NO: 128 - protein, 442 aa, Mus musculus
MSAAKIWRPSRGLRQAALLLLGRSGVRGLARSHPSRQQQQQFPSLDDKPQFPGASAEFVDKLEFIQPNVISGIPIYRVMDRQGQIINPSEDPHLPQEEVLKFYRSMTLLNTMDRILYESQRQGRISFYMTNYGEEGTHVGSAAALERTDLVFGQYREAGVLMYRDYPLELFMSQCYGNVNDPGKGRQMPVHYGCKERHFVTISSPLATQIPQAVGAAYAAKRANANRIVICYFGEGAASEGDAHAGFNFAATLECPIIFFCRNNGYAISTPTSEQYRGDGIAARGPGYGIKSIRVDGNDVFAVYNATKEARRRAVAENQPFLIEAMTYRIGHHSTSDDSSAYRSVDEVNYWDKQDHPISRLRQYLLNQGWWDEEQEKAWRKQSRKKVMEAFEQAERKLKPNPSLLFSDVYQEMPAQLRRQQESLARHLQTYGEHYPLDHFEK

SEQ ID NO: 129 - protein, 520 aa, Homo sapiens
MAALKLLSSGLRLCASARGSGATWYKGCVCSFSTSAHRHTKFYTDPVEAVKDIPDGATVLVGGFGLCGIPENLIDALLKTGVKGLTAVSNNAGVDNFGLGLLLRSKQIKRMVSSYVGENAEFERQYLSGELEVELTPQGTLAERIRAGGAGVPAFYTPTGYGTLVQEGGSPIKYNKDGSVAIASKPREVREFNGQHFILEEAITGDFALVKAWKADRAGNVIFRKSARNFNLPMCKAAETTVVEVEEIVDIGAFAPEDIHIPQIYVHRLIKGEKYEKRIERLSIRKEGDGEAKSAKPGDDVRERIIKRAALEFEDGMYANLGIGIPLLASNFISPNITVHLQSENGVLGLGPYPRQHEADADLINAGKETVTILPGASFFSSDESFAMIRGGHVDLTMLGAMQVSKYGDLANWMIPGKMVKGMGGAMDLVSSAKTKVVVTMEHSAKGNAHKIMEKCTLPLTGKQCVNRIITEKAVFDVDKKKGLTLIELWEGLTVDDVQKSTGCDFAVSPKLMPMQQIAN

SEQ ID NO: 130 - protein, 221 aa, Caenorhabditis elegans
MLQNTVRCVSKLVQPITGVAAVRSKHSLPDLPYDYADLEPVISHEIMQLHHQKHHATYVNNLNQIEEKLHEAVSKGNVKEAIALQPALKFNGGGHINHSIFWTNLAKDGGEPSAELLTAIKSDFGSLDNLQKQLSASTVAVQGSGWGWLGYCPKGKILKVATCANQDPLEATTGLVPLFGIDVWEHAYYLQYKNVRPDYVNAIWKIANWKNVSERFAKAQQ

SEQ ID NO: 131 - protein, 218 aa, Caenorhabditis elegans
MLQSTARTASKLVQPVAGVLAVRSKHTLPDLPFDYADLEPVISHEIMQLHHQKHHATYVNNLNQIEEKLHEAVSKGNLKEAIALQPALKFNGGGHINHSIFWTNLAKDGGEPSKELMDTIKRDFGSLDNLQKRLSDITIAVQGSGWGWLGYCKKDKILKIATCANQDPLEGMVPLFGIDVWEHAYYLQYKNVRPDYVHAIWKIANWKNISERFANARQ

SEQ ID NO: 132 - protein, 587 aa, Homo sapiens
MVTAAMLLQCCPVLARGPTSLLGKVVKTHQFLFGIGRCPILATQGPNCSQIHLKATKAGGDSPSWAKGHCPFMLSELQDGKSKIVQKAAPEVQEDVKAFKTDLPSSLVSVSLRKPFSGPQEQEQISGKVTHLIQNNMPGNYVFSYDQFFRDKIMEKKQDHTYRVFKTVNRWADAYPFAQHFSEASVASKDVSVWCSNDYLGMSRHPQVLQATQETLQRHGAGAGGTRNISGTSKFHVELEQELAELHQKDSALLFSSCFVANDSTLFTLAKILPGCEIYSDAGNHASMIQGIRNSGAAKFVFRHNDPDHLKKLLEKSNPKIPKIVAFETVHSMDGAICPLEELCDVSHQYGALTFVDEVHAVGLYGSRGAGIGERDGIMHKIDIISGTLGKAFGCVGGYIASTRDLVDMVRSYAAGFIFTTSLPPMVLSGALESVRLLKGEEGQALRRAHQRNVKHMRQLLMDRGLPVIPCPSHIIPIRVGNAALNSKLCDLLLSKHGIYVQAINYPTVPRGEELLRLAPSPHHSPQMMEDFVEKLLLAWTAVGLPLQDVSVAACNFCRRPVHFELMSEWERSYFGNMGPQYVTTYA

SEQ ID NO: 133 - protein, 640 aa, Homo sapiens
MESVVRRCPFLSRVPQAFLQKAGKSLLFYAQNCPKMMEVGAKPAPRALSTAAVHYQQIKETPPASEKDKTAKAKVQQTPDGSQQSPDGTQLPSGHPLPATSQGTASKCPFLAAQMNQRGSSVFCKASLELQEDVQEMNAVRKEVAETSAGPSVVSVKTDGGDPSGLLKNFQDIMQKQRPERVSHLLQDNLPKSVSTFQYDRFFEKKIDEKKNDHTYRVFKTVNRRAHIFPMADDYSDSLITKKQVSVWCSNDYLGMSRHPRVCGAVMDTLKQHGAGAGGTRNISGTSKFHVDLERELADLHGKDAALLFSSCFVANDSTLFTLAKMMPGCEIYSDSGNHASMIQGIRNSRVPKYIFRHNDVSHLRELLQRSDPSVPKIVAFETVHSMDGAVCPLEELCDVAHEFGAITFVDEVHAVGLYGARGGGIGDRDGVMPKMDIISGTLGKAFGCVGGYIASTSSLIDTVRSYAAGFIFTTSLPPMLLAGALESVRILKSAEGRVLRRQHQRNVKLMRQMLMDAGLPVVHCPSHIIPVRVADAAKNTEVCDELMSRHNIYVQAINYPTVPRGEELLRIAPTPHHTPQMMNYFLENLLVTWKQVGLELKPHSSAECNFCRRPLHFEVMSEREKSYFSGLSKLVSAQA

SEQ ID NO: 134 - protein, 903 aa, Homo sapiens; identical to SEQ ID NO: 61

SEQ ID NO: 135 - protein, 586 aa, Mus musculus
WFVLSAGQQDFGLRMVAAAMLLRSCPVLSQGPTGLLGKVAKTYQFLFSIGRCPILATQGPTCSQIHLKATKAGGELQDRKSKIVQRAAPEVQEDVKTFKTDLLSTMDSTTRSHSFPSFQEPEQTEGAVPHLIQNNMTGSQAFGYDQFFRDKIMEKKQDHTYRVFKTVNRWANAYPFAQHFSEASMASKDVSVWCSNDYLGISRHPRVLQAIEETLKNHGAGAGGTRNISGTSKFHVELEQELAELHQKDSALLFSSCFVANDSTLFTLAKLLPGCEIYSDAGNHASMIQGIRNSGAAKFVFRHNDPGHLKKLLEKSDPKTPKIVAFETVHSMDGAICPLEELCDVAHQYGALTFVDEVHAVGLYGARGAGIGERDGIMHKLDIISGTLGKAFGCVGGYIASTRDLVDMVRSYAAGFIFTTSLPPMMLSGALESVRLLKGEEGQALRRAHQRNVKHMRQLLMDRGFPVIPCPSHIIPIRVGNAALNSKICDLLLSKHSIYVQAINYPTVPRGEELLRLAPSPHHSPQMMENFVEKLLLAWTEVGLPLQDVSVAACNFCHRPVHFELMSEWERSYFGNMGPQYVTTYA

SEQ ID NO: 136 - protein, 994 aa, Neurospora crassa
MPLICARPLGRLVPKLGASLRPVLSSHAASPRRPVGVALEQHLGTESWKRFYADHKLDLLALDQKWRQKWAESSREKGNKEDEKNKYVLPMFPYPSGHLHLGHLRVYTIADVIARFQTLQGHKVLLPMGWDAFGLPAENAAIERGINPATWTKANIAKMKEQLGHMNGSWDWNCELATCDPDFYKHTQKIFLALHEKGLAYQAEAEVNYDPVDKTVLANEQVDANGCSWRSGARVEKRKLKQWFLKISEFRESLLKDLETLAKNEAWPERVLAMQKNWLGKSKGATVKFPVLAFGQGTPSAIEVFTSRPDTLFGVQYIALAATHPSVQQLAKSDPELQAFLSTLPGLSPDSKVGYLLPHIRAVNPLAYHEETPEDTKVSLPIYVAPYVLGDYGEGAVMGVPGHDLRDHAFWKEHHYDAPVRFVLAASEDESTTAMPNEPFTEHGVMNANSGIFKGKSSKEAGEMLVKLLEPAGLAKETEKWRLRDWLISRQRYWGTPIPIVHCGSCGTVPVPDEQLPVELPEVDEHWAGKKTGNPLESQTDWINTSCPKCGGEAKRDTDTMDTFVDSSWYYMRFIDAHNKEAPFSPEKAKVLTPVDLYIGGVEHAILHLLYSRFIYKFLMTSSFAGKEAESAEAAESASSEVYEPFKRLITQGMVHGKTYTDPATGRFLKPDEVDLSDPHQPKVVATGALANVSYEKMSKSKHNGVDPTTFIAQYGADATRAHILFQAPVSEILDWDESKITGVTRWLSRVHDLVQKIACSSTSETPSSASTVKAFFEQQQQQPESVADPAKLDASITIWREVQRTISSVTASYNKVYTLNTVISDLMSLTNVIASPSNYDAADPLIRREAVSALIRMMAPVAPAFAEECWHVLFPESSSSSLFSGSGSGSGSGSGDEQAARFPVPDGTEGLLKSRKQTCAVQLNGKTKFAVEIGTPPAGLLEKSAEEKLREFIVGEVLKTEEGRAKLEGRGVDVSKAKKVIVVRGGKLLNVVM

SEQ ID NO: 137 - protein, 531 aa, Neurospora crassa
MLLRTKALIRSGGSIAKYAAANPSCFILQRRGLRREFGPKYTAKINEAEENWQARAEAIKKGKKQNTWDLFEERGYVKDTAGTKEHIAELMRTRRIGAYVGIDPTAPSLHVGHLLPLMPLFWMYLEGYKAFTLIGGSTAKIGDPTGRLKSRDHLSSSDATMNMTKIHYQLKKLWENVDTQMRARGYEADWARKRGIVNNNHWWNKQPMLEVLRRVGHALRIGPMLSRDTVKNKMTQGDGVSFAEFTYPIMQGWDWFELFYQQGVQMQIGGSDQYGNIISGLEVVKAARESEPDPQERKYVTPKTALDECVGFTVPLLTDSSGAKFGKSAGNAIWLDPYQTSVFDFYGYFVRRSDQEVENLLKLFTFMPISEITKTMEEHIKDPSKRVAQHTLAREVVTLVHGKQEASAAEDQHRMMYTGQMTIPQVSRAKDAATGGDQYKTISDQPVTLNNAPRIDMILPESLIMGKSIGRILSPPVLPAAPPRATSSRLPRAATSADAQSRRRERHHEPGPHLFYARQAVVPRRDPALPD

SEQ ID NO: 138 - protein, 350 aa, Caenorhabditis elegans
MRNYDFQPNNLRLLSTSTHPTIYFTGFQPTGTPHLGNFFGSIEPWTELQNSVDKNILMMLSVVDQHAISLGPLPANELRQNTHGMTASLIACGVDPNRTLLFRQSDVPQIAQFSWFLGSLQTTSKLARLPQYKEKKERFKKGDIPVGLLTYPLLQAADVLTFKATTVPVGEDQSQHLNLLGGLAYAFNKTYETEIFPIPKQLTRESHARIRSLRGPEKKMSKSSGGPRSRIEITDSRSTIIEKCQLAQSDNAGKVTYDKENRLAVSNLLDLYSAVTKTQTSEIDFSNWTTLDLKMNLAEAVDKRLAPIRQKFEELQNTGEVDKVLTENGEKAREIAEKNLEEIRRTIGFL

SEQ ID NO: 139 - protein, 297 aa, Mus musculus
MVHQVLYRALVSTKWLAESIRSGRLGPSLRVLDASWYSPGTRQARKEYQERHVPGASFFDIEECRDTTSPYEMMLPSEAHFGDYVGNLGISNDTHVVVYDGDDLGSFYAPRVWWMFRVFGHRTVSVLNGGFRNWLKEGHPVTSEPSRPEPAVFKATLNLSLLKTYEQVLENLQSKRFQLVDSRAQGRYLGTQPEPDIVGLDSGHIRGSVNMPFMDFLTKDGFEKSPEELRAIFQDKKVDLSQPLIATCRKGVTACHVALAAYLCGKPDVAVYDGSWSEWFRRAPPETRVSQGKSGKA

SEQ ID NO: 140 - protein, 713 aa, Homo sapiens
MLCVGRLGGLGARAAALPPRRAGRGSLEAGIRARRVSTSWSPVGAAFNVKPQGSRLDLFGERRRLFGVPELSAPEGFHIAQEKALRKTELLVDRACSTPPGPQTVLIFDELSDSLCRVADLADFVKIAHPEPAFREAAEEACRSIGTMVEKLNTNVDLYQSLQKLLADKKLVDSLDPETRRVAELFMFDFEISGIHLDKEKRKRAVDLNVKILDLSSTFLMGTNFPNKIEKHLLPEHIRRNFTSAGDHIIIDGLHAESPDDLVREAAYKIFLYPNAGQLKCLEELLSSRDLLAKLVGYSTFSHRALQGTIAKNPETVMQFLEKLSDKLSERTLKDFEMIRGMKMKLNAQNSEVMPWDPPYYSGVIRAERYNIEPSLYCPFFSLGACMEGLNILLNRLLGISLYAEQPAKGEVWSEDVRKLAVVHESEGLLGYIYCDFFQRADKPHQDCHFTIRGGRLKEDGDYQLPVVVLMLNLPRSSRSSPTLLTPGMMENLFHEMGHAMHSMLGRTRYQHVTGTRCPTDFAEVPSILMEYFANDYRVVNQFARHYQTGQPLPKNMVSRLCESKKVCAAADMQLQVFYATLDQIYHGKHPLRNSTTDILKETQEKFYGLPYVPNTAWQLRFSHLVGYGARYYSYLMSRAVASMVWKECFLQDPFNRAAGERYRREMLAHGGGREPMLMVEGMLQKCPSVDDFVSALVSDLDLDFETFLMDSE

SEQ ID NO: 141 - protein, 501 aa, Homo sapiens
MAASWRLGCDPRLLRYLVGFPGRRSVGLVKGALGWSVSRGRNWRWFHSTQWLRGDPIKILMPSLSPTMEEGNIVKWLKKEGEAVSAGDALCEIETDKAVVTLDASDDGILAKIVVEEGSKNIRLGSLIGLIVEEGEDWKHVEIPKDVGPPPPVSKPSEPRPSPEPQISIPVKKEHIPGTLRFRLSPAARNILEKHSLDASQGTATGPRGIFTKEDALKLVQLKQTGKITESRPTPAPTATPTAPSPLQATAGPSYPRPVIPPVSTPGQPNAVGTFTEIPASNIRRVIAKRLTESKSTVPHAYATADCDLGAVLKVRQDLVKDDIKVSVNDFIIKAAAVTLKQMPDVNVSWDGEGPKQLPFIDISVAVATDKGLLTPIIKDAAAKGIQEIADSVKALSKKARDGKLLPEEYQGGSFSISNLGMFGIDEFTAVINPPQACILAVGRFRPVLKLTEDEEGNAKLQQRQLITVTMSSDSRVVDDELATRFLKSFKANLENPIRLA

SEQ ID NO: 142 - protein, 430 aa, Homo sapiens
MALLHSGRVLPGIAAAFHPGLAAAASARASSWWTHVEMGPPDPILGVTEAFKRDTNSKKMNLGVGAYRDDNGKPYVLPSVRKAEAQIAAKNLDKEYLPIGGLAEFCKASAELALGENSEVLKSGRFVTVQTISGTGALRIGASFLQRFFKFSRDVFLPKPTWGNHTPIFRDAGMQLQGYRYYDPKTCGFDFTGAVEDISKIPEQSVLLLHACAHNPTGVDPRPEQWKEIATVVKKRNLFAFFDMAYQGFASGDGDKDAWAVRHFIEQGINVCLCQSYAKNMGLYGERVGAFTMVCKDADEAKRVESQLKILIRPMYSNPPLNGARIAAAILNTPDLRKQWLQEVKGMADRIIGMRTQLVSNLKKEGSTHNWQHITDQIGMFCFTGLKPEQVERLIKEFSIYMTKDGRISVAGVTSSNVGYLAHAIHQVTK

SEQ ID NO: 143 - protein, 439 aa, Homo sapiens
MFSKLAHLQRFAVLSRGVHSSVASATSVATKKTVQGPPTSDDIFEREYKYGAHNYHPLPVALERGKGIYLWDVEGRKYFDFLSSYSAVNQGHCHPKIVNALKSQVDKLTLTSRAFYNNVLGEYEEYITKLFNYHKVLPMNTGVEAGETACKLARKWGYTVKGIQKYKAKIVFAAGNFWGRTLSAISSSTDPTSYDGFGPFMPGFDIIPYNDLPALERALQDPNVAAFMVEPIQGEAGVVVPDPGYLMGVRELCTRHQVLFIADEIQTGLARTGRWLAVDYENVRPDIVLLGKALSGGLYPVSAVLCDDDIMLTIKPGEHGSTYGGNPLGCRVAIAALEVLEEENLAENADKLGIILRNELMKLPSDVVTAVRGKGLLNAIVIKETKDWDAWKVCLRLRDNGLLAKPTHGDIIRFAPPLVIKEDELRESIEIINKTILSF

SEQ ID NO: 144 - protein, 392 aa, Homo sapiens; identical to SEQ ID NO: 102

SEQ ID NO: 145 - protein, 439 aa, Mus musculus
MLSKLASLQTIAALRRGVHTSVASATSVATKKTEQGPPSSEYIFERESKYGAHNYHPLPVALERGKGIYMWDVEGRQYFDFLSAYGAVSQGHCHPKIIDAMKSQVDKLTLTSRAFYNNVLGEYEEYITKLFNYNKVLPMNTGVEAGETACKLARRWGYTVKGIQKYKAKIVFADGNFWGRTLSAISSSTDPTSYDGFGPFMPGFETIPYNDLPALERALQDPNVAAFMVEPIQGEAGVIVPDPGYLTGVRELCTRHQVLFIADEIQTGLARTGRWLAVDHENVRPDMVLLGKALSGGLYPVSAVLCDDEIMLTIKPGEHGSTYGGNPLGCRIAIAALEVLEEENLAENADKMGAILRKELMKLPSDVVTSVRGKGLLNAIVIRETKDCDAWKVCLRLRDNGLLAKPTHGDIIRLAPPLVIKEDEIRESVEIINKTILSF

SEQ ID NO: 146 - protein, 615 aa, Homo sapiens
RVTSRSGPAPARRNSVTTGYGGVRALCGWTPSSGATPRNRLLLQLLGSPGRRYYSLPPHQKVPLPSLSPTMQAGTIARWKKKEGDKINEGDLIAEVETDKATVGFESLEECYMAKILVAEGTRDVPIGAIICITVGKPEDIEAFKNYTLDSSAAPTPQAAPAPTPAATASPPTPSAQAPGSSYPPHMQVLLPALSPTMTMGTVQRWEKKVGEKLSEGDLLAEIETDKATIGFEVQEEGYLAKILVPEGTRDVPLGTPLCIIVEKEADISAFADYRPTEVTDLKPQVPPPTPPPVAAVPPTPQPLAPTPSAPCPATPAGPKGRVFVSPLAKKLAVEKGIDLTQVKGTGPDGRITKKDIDSFVPSKVAPAPAAVVPPTGPGMAPVPTGVFTDIPISNIRRVIAQRLMQSKQTIPHYYLSIDVNMGEVLLVRKELNKILEGRSKISVNDFIIKASALACLKVPEANSSWMDTVIRQNHVVDVSVAVSTPAGLITPIVFNAHIKGVETIANDVVSLATKAREGKLQPHEFQGGTFTISNLGMFGIKNFSAIINPPQACILAIGASEDKLVPADNEKGFDVASMMSVTLSCDHRVVDGAVGAQWLAEFRKYLEKPITMLL

SEQ ID NO: 147 - protein, 177 aa, Saccharomyces cerevisiae
MKHTTSTMLRTTRLWTTRMPAVSKLFLRNSSGNALNKNKLPFLYSSQGPQAVRYTSQHEWIAVHQDKTAFVGITKYATDSLGDATYVELPEVGTEISQGESLGSIESVKSASEIYQPADGTVEEINTNLEENPGVVNEDPMGDGWLVKMKLGEGVNVEQVEGLMSLEQYEKTLVHDD

SEQ ID NO: 148 - protein, 1133 aa, Saccharomyces cerevisiae
MLRTRTTKTLSTVARTTRAIQYYRSIAKTAAVSQRRFASTLTVRDVENIKPSHIIKSPTWQEFQHQLKDPRYMEHFAQLDAQFARHFMATNSGKSILAKDDSTSQKKDEDVKIVPDEKDTDNDVEPTRDDEIVNKDQEGEASKNSRSSASGGGQSSSSRSDSGDGSSKQKPPKDVPEVYPQMLALPIARRPLFPGFYKAVVISDERVMKAIKEMLDRQQPYIGAFMLKNSEEDTDVITDKNDVYDVGVLAQITSAFPSKDEKTGTETMTALLYPHRRIKIDELFPPNEEKEKSKEQAKDTDTETTVVEDANNPEDQESTSPATPKLEDIVVERIPDSELQHHKRVEATEEESEELDDIQEGEDINPTEFLKNYNVSLVNVLNLEDEPFDRKSPVINALTSEILKVFKEISQLNTMFREQIATFSASIQSATTNIFEEPARLADFAAAVSAGEEDELQDILSSLNIEHRLEKSLLVLKKELMNAELQNKISKDVETKIQKRQREYYLMEQLKGIKRELGIDDGRDKLIDTYKERIKSLKLPDSVQKIFDDEITKLSTLETSMSEFGVIRNYLDWLTSIPWGKHSKEQYSIPRAKKILDEDHYGMVDVKDRILEFIAVGKLLGKVDGKIICFVGPPGVGKTSIGKSIARALNRKFFRFSVGGMTDVAEIKGHRRTYIGALPGRVVQALKKCQTQNPLILIDEIDKIGHGGIHGDPSAALLEVLDPEQNNSFLDNYLDIPIDLSKVLFVCTANSLETIPRPLLDRMEVIELTGYVAEDKVKIAEQYLVPSAKKSAGLENSHVDMTEDAITALMKYYCRESGVRNLKKHIEKIYRKAALQVVKKLSIEDSPTSSADSKPKESVSSEEKAENNAKSSSEKTKDNNSEKTSDDIEALKTSEKINVSISQKNLKDYVGPPVYTTDRLYETTPPGVVMGLAWTNMGGCSLYVESVLEQPLHNCKHPTFERTGQLGDVMKESSRLAYSFAKMYLAQKFPENRFFEKASIHLHCPEGATPKDGPSAGVTMATSFLSLALNKSIDPTVAMTGELTLTGKVLRIGGLREKAVAAKRSGAKTIIFPKDNLNDWEELPDNVKEGLEPLAADWYNDIFQKLFKDVNTKEGNSVWKAEFEILDAKKEKD

SEQ ID NO: 149 - protein, 232 aa, Saccharomyces cerevisiae
MFPYLTRMNLSIKMGGLTLKESSPNAFLNNTTIARRFKHEYAPRFKIVQKKQKGRVPVRTGGSIKGSTLQFGKYGLRLKSEGIRISAQQLKEADNAIMRYVRPLNNGHLWRRLCTNVAVCIKGNETRMGKGKGGFDHWMVRVPTGKILFEINGDDLHEKVAREAFRKAGTKLPGVYEFVSLDSLVRVGLHSFKNPKDDPVKNFYDENAKKPSKKYLNILKSQEPQYKLFRGR

SEQ ID NO: 150 - protein, 541 aa, Saccharomyces cerevisiae
MLRLARFYSLARTKAIHSHGAPFRPEYALKCGLEIHTQLNTKNKLFSQSTNSATSLVDAPNHHTSYYDIALPGTQPVLNLEAILFAMKLSLALGSQVNSISQFDRKHYFYGDQPQGYQLTQHYRPFARGGKINLSKELDDIDESAKEIGILQLQIEQDTGKSHYTETDKDVITLVDLNRSNVPLIELVTKPDFSDIKQVRAFIKKYQNLVRHLHISSGDLETGAMRVDVNLSINEYARVELKNLPNTSSIINAIKYEYQRQVELISVGDTSSLMEPETRGWTGSSTVKLRSKETTIDYRYMPDPELPYINLAPDVISGVRGLMPQLPDDIMRILMKKPYQLSLKDAKILTYNSNQNDMYNHEALRSYYLDTFREFSKLAGERSNAKLPTNWIIHEFLGDLNKLQIPLAKAKEILAPPVFAQFLKLLHEEVISATSGKMLLFHILENFEQSNCQDLSIPDFSKLIEKFELHAINQVDPQELMDLCNDVIAQHTDDTFIRNLVTGKKKSSLKFLIGQGMRRSQGRIKANEFEKKFKEILNIQW

SEQ ID NO: 151 - protein, 177 aa, Saccharomyces cerevisiae
MLKSTLRLSRISLRRGFTTIDCLRQQNSDIDKIILNPIKLAQGSNSDRGQTSKSKTDNADILSMEIPVDMMQSAGRINKRELLSEAEIARSSVENAQMRFNSGKSIIVNKNNPAESFKRLNRIMFENNIPGDKRSQRFYMKPGKVAELKRSQRHRKEFMMGFKRLIEIVKDAKRKGY

SEQ ID NO: 152 - protein, 162 aa, Saccharomyces cerevisiae
MSSSQVVRDSAKKLVNLLEKYPKDRIHHLVSFRDVQIARFRRVAGLPNVDDKGKSIKEKKPSLDEIKSIINRTSGPLGLNKEMLTKIQNKMVDEKFTEESINEQIRALSTIMNNKFRNYYDIGDKLYKPAGNPQYYQRLINAVDGKKKESLFTAMRTVLFGK

SEQ ID NO: 153 - protein, 196 aa, Saccharomyces cerevisiae
MPPERTGTNANEHTFCSLLMLKSIFAKRFASTGSYPGSTRITLPRRPAKKIQLGKSRPAIYHQFNVKMELSDGSVVIRRSQYPKGEIRLIQDQRNNPLWNPSRDDLVVVDANSGGSLDRFNKRYSSLFSVDSTTPNSSSETVELSEENKKKTQIKKEEKEDVSEKAFGMDDYLSLLDDSEQQIKSGKLASKKRDKK

SEQ ID NO: 154 - protein, 278 aa, Saccharomyces cerevisiae
MFSRLSLFRRAALAPAPMRMSFRTIYQKTEDELPRRIVPKLATFYSANPNHEDRINRLERLLRKYIKLPSQNNNEAQQTKAPWISFDEYALIGGGTKLKPTQYTQLLYMLNKLHNIDPQLTNDEITSELSQYYKKSSMLSNNIKIKTLDEFGRSIAVGKRKSSTAKVFVVRGTGEILVNGRQLNDYFLKMKDRESIMYPLQVIESVGKYNIFATTSGGGPTGQAESIMHAIAKALVVFNPLLKSRLHKAGVLTRDYRHVERKKPGKKKARKMPTWVKR

SEQ ID NO: 155 - protein, 366 aa, Saccharomyces cerevisiae
MFSRLPTSLARNVARRAPTSFVRPSAAAAALRFSSTKTMTVREALNSAMAEELDRDDDVFLIGEEVAQYNGAYKVSKGLLDRFGERRVVDTPITEYGFTGLAVGAALKGLKPIVEFMSFNFSMQAIDHVVNSAAKTHYMSGGTQKCQMVFRGPNGAAVGVGAQHSQDFSPWYGSIPGLKVLVPYSAEDARGLLKAAIRDPNPVVFLENELLYGESFEISEEALSPEFTLPYKAKIEREGTDISIVTYTRNVQFSLEAAEILQKKYGVSAEVINLRSIRPLDTEAIIKTVKKTNHLITVESTFPSFGVGAEIVAQVMESEAFDYLDAPIQRVTGADVPTPYAKELEDFAFPDTPTIVKAVKEVLSIE

SEQ ID NO: 156 - protein, 520 aa, Saccharomyces cerevisiae
MLKSASQNFFRAYSSRIGRYAATASGKLAQSRLSNIPTPKALKKFLDEYIVGQEIGKKVLSVAVYNHYLRINDKQKKGELQRQRELMEREKIADDRDEPIFSGNSESKAGWRNLQRQFNLAGREVDEDLELSKSNVLVVGPSGSGKTLLATTLAKILNVPIAITDCTQLTQAGYIGEDVEVCIERLLVNAEFDVARAEKGIIVLDEIDKLAKPAASIGTKDVSGEGVQQSLLKIIEGHKVEITVKRPVKHDIDGQKNQTTTKKDEVFVVDTSNILFMIMGAFVGLDKHIVKRIEDMKKIQKAGESVESSNSKEVEKERAKKFRFSNTLEQVELDNGKKVCALDLTTPTDLVSFGLIPELIGRVPIITALQPLQRDDLFHILKEPKNALLDQYEYIFKQFGVRLCVTQKALKKVAQFALKEGTGARGLRGIMERLLLNVNYDCPGSNIAYVLIDEATVDSLQETEHSLASQVDVKYYSGDEKDSLIRDVSEEDKKLGVMLEKELGHSANIHTPTIPKRSLT

SEQ ID NO: 157 - protein, 307 aa, Saccharomyces cerevisiae
MFKRQLSTSVRYLQHYDESLLSRYYPESLLKSIKLAQQTIPEDTKFRVSRNVEFAPPYLDDFTKIHPFWDYKPGMPHLHAQEENNNFSIFRWDQVQQPLPGEGNILPPGVSLPNDGGRKSKSADVAAGLHKQTGVDPDYITRKLTMKPLVMKRVSNQTGKGKIASFYALVVVGDKNGMVGLGEGKSREEMSKAIFKAHWDAVRNLKEIPRYENRTIYGDIDFRYHGVKLHLRSAKPGFGLRVNHVIFEICECAGIKDLSGKVYKSRNDMNIAKGTIEAFTKAQKTLDEVALGRGKKLVDVRKVYYSS

SEQ ID NO: 158 - protein, 105 aa, Saccharomyces cerevisiae
MLARSLGYRLISTSRILYNKPTVKSVVSSCPAGTSLNLNIWKSGKDAVALEDKEYPNWLWSVLDSDHVVEHAAEDPEGQALLKRRKNIRKANRQRIKQNNFLSQL

SEQ ID NO: 159 - protein, 146 aa, Saccharomyces cerevisiae
MKGSPISQFSKTSINALTRPWKKYRDGELFYGLSKVGNKRVPLTTKQGNKTMYKGTRASGIGRHTKFGGYVINWKKVRTYVTPDMVNFELKPYVNANVPPLKHEFKGFSGGPLDPRLQLLKIKEYIVNGRVQSEGATDTSCYKERG

SEQ ID NO: 160 - protein, 183 aa, Saccharomyces cerevisiae
MNSLIFGKQLAFHKIVPTTAIGWLVPLGNPSLQIPGQKQLGSIHRWLREKLQQDHKDTEDKDFFSNNGILLAVPKKKVSHQKKRQKLYGPGKKQLKMIHHLNKCPSCGHYKRANTLCMYCVGQISHIWKTHTAKEEIKPRQEEELSELDQRVLYPGRRDTKYTKDLKDKDNYLERRVRTLKKD

SEQ ID NO: 161 - protein, 492 aa, Saccharomyces cerevisiae
MFHAFTFLKGGRFYSSLTVKSLYEQVHHTSHDPISINGWIKSIRLLKRIAFLDLQDGTSVNPLRIVIPLTNTDEVQFLKILKTGQTLSISNATWQSTPNRKQPFELQIKNPVKSIKLVGPVSENYPLQKKYQTLRYLRSLPTLKYRTAYLSAILRLRSFVEFQFMLYFQKNHFTKVSPPILTSNDCEGAGELFQVSTNTSPTASSYFGKPTYLTVSTQLHLEILALSLSRCWTLSPCFRAEKSDTPRHLSEFWMLEVEMCFVNSVNELTSFVETTIKHIIKACIDNQQELLPKQFISSQENNASSELSINQETQQIKTRWEDLINEKWHNITYTNAIEILKKRHNEVSHFKYEPKWGQPLQTEHEKFLAGEYFKSPVFVTDYPRLCKPFYMKQNSTPDDTVGCFDLLVPGMGEIIGGSLREDDYDKLCREMKARGMNRSGELDWYVSLRKEGSAPHGGFGLGFERFISYLYGNHNIKDAIPFYRTSAESIDF

SEQ ID NO: 162 - protein, 135 aa, Saccharomyces cerevisiae
MFLRTQARFFHATTKKMDFSKMSIVGRIGSEFTEHTSANNNRYLKYSIASQPRRDGQTNWYNITVFNEPQINFLTEYVRKGALVYVEADAANYVFERDDGSKGTTLSLVQKDINLLKNGKKLEDAEGQENAASSE

SEQ ID NO: 163 - protein, 169 aa, Saccharomyces cerevisiae
MWSRNVRLLGSWTRSYMVPATKRKTIPVYPPVQRIASSQIMKQVALSEIESLDPGAVKRKLISKKNKDRLKAGDVVRIVYDSSKCSYDTFVGYILSIDRKQLVQDASLLLRNQIAKTAVEIRVPLFSPLIERIDLLTPHVSSRQRNKHYYIRGTRLDVGDLEAGLRRKK

SEQ ID NO: 164 - protein, 249 aa, Saccharomyces cerevisiae
MLQLRFMPGWVPRNGFFGLKETIGTVHKRFYALASEQPSRKTVKPLDSRKTFLIDTYKHLMENSSMIFFVHYNNLSKTEDHHFRFKIKQTGGKLTKVRNNLFEVYLRNSHLPDPCGFVKRKEQNWKHPLLPLLKGPTATITYEDTNPQQVAKLLKVLQSAQDKLMVIGAKVENEVLNVEKINTFKTLPTKPEMQSQLVSVLQMLSGLGLVRTLENSSNALYLTLKSHNDNQKPKEDVESTTDAESKGSK

SEQ ID NO: 165 - protein, 463 aa, Saccharomyces cerevisiae
MLSRATRTAAAKSLVKSKVARNVMAASFVKRHASTSLFKQANKVESLGSIYLSGKKISVAANPFSITSNRFKSTSIEVPPMAESLTEGSLKEYTKNVGDFIKEDELLATIETDKIDIEVNSPVSGTVTKLNFKPEDTVTVGEELAQVEPGEAPAEGSGESKPEPTEQAEPSQGVAARENSSEETASKKEAAPKKEAAPKKEVTEPKKADQPKKTVSKAQEPPVASNSFTPFPRTETRVKMNRMRLRIAERLKESQNTAASLTTFNEVDMSALMEMRKLYKDEIIKKTGTKFGFMGLFSKACTLAAKDIPAVNGAIEGDQIVYRDYTDISVAVATPKGLVTPVVRNAESLSVLDIENEIVRLSHKARDGKLTLEDMTGGTFTISNGGVFGSLYGTPIINSPQTAVLGLHGVKERPVTVNGQIVSRPMMYLALTYDHRLLDGREAVTFLKTVKELIEDPRKMLLW

SEQ ID NO: 166 - protein, 664 aa, Saccharomyces cerevisiae
MLTSILIKGRTPVLASRNLLAALSNCNHITWAVSRRLYNDGNRDQRNFGRNQRNNNSNRYRNSRFNSRPRTRSREDDDEVHFDKTTFSKLIHVPKEDNSKEVTLDSLLEEGVLDKEIHKAITRMEFPGLTPVQQKTIKPILSSEDHDVIARAKTGTGKTFAFLIPIFQHLINTKFDSQYMVKAVIVAPTRDLALQIEAEVKKIHDMNYGLKKYACVSLVGGTDFRAAMNKMNKLRPNIVIATPGRLIDVLEKYSNKFFRFVDYKVLDEADRLLEIGFRDDLETISGILNEKNSKSADNIKTLLFSATLDDKVQKLANNIMNKKECLFLDTVDKNEPEAHERIDQSVVISEKFANSIFAAVEHIKKQIKERDSNYKAIIFAPTVKFTSFLCSILKNEFKKDLPILEFHGKITQNKRTSLVKRFKKDESGILVCTDVGARGMDFPNVHEVLQIGVPSELANYIHRIGRTARSGKEGSSVLFICKDELPFVRELEDAKNIVIAKQEKYEPSEEIKSEVLEAVTEEPEDISDIVISLISSYRSCIKEYRFSERRILPEIASTYGVLLNDPQLKIPVSRRFLDKLGLSRSPIGKAMFEIRDYSSRDGNNKSYDYDDDSEISFRGNKNYNNRSQNRDYDDEPFRRSNNNRRSFSRSNDKNNYSSRNSNIY

SEQ ID NO: 167 - protein, 147 aa, Saccharomyces cerevisiae
MLAQTFKKPHRAVLEQVSGTTVFIRNKRTKSKSSLSPLAQRVVTQLSVMSASRKQPKLLKLAREDLIKHQTIEKCWSIYQQQQRERRNLQLELQYKSIERSMNLLQELSPRLFEAANASEKGKRFPMEMKVPTDFPPNTLWHYNFRK

SEQ ID NO: 168 - protein, 499 aa, Saccharomyces cerevisiae
MLRIRSLLNNKRAFSSTVRTLTINKSHDVVIIGGGPAGYVAAIKAAQLGFNTACVEKRGKLGGTCLNVGCIPSKALLNNSHLFHQMHTEAQKRGIDVNGDIKINVANFQKAKDDAVKQLTGGIELLFKKNKVTYYKGNGSFEDETKIRVTPVDGLEGTVKEDHILDVKNIIVATGSEVTPFPGIEIDEEKIVSSTGALSLKEIPKRLTIIGGGIIGLEMGSVYSRLGSKVTVVEFQPQIGASMDGEVAKATQKFLKKQGLDFKLSTKVISAKRNDDKNVVEIVVEDTKTNKQENLEAEVLLVAVGRRPYIAGLGAEKIGLEVDKRGRLVIDDQFNSKFPHIKVVGDVTFGPMLAHKAEEEGIAAVEMLKTGHGHVNYNNIPSVMYSHPEVAWVGKTEEQLKEAGIDYKIGKFPFAANSRAKTNQDTEGFVKILIDSKTERILGAHIIGPNAGEMIAEAGLALEYGASAEDVARVCHAHPTLSEAFKEANMAAYDKAIHC

SEQ ID NO: 169 - protein, 427 aa, Saccharomyces cerevisiae
MYSRKSLSLISKCGQLSRLNAQAALQARRHLSIHEYRSAQLLREYGIGTPEGFPAFTPEEAFEAAKKLNTNKLVIKAQALTGGRGKGHFDTGYKSGVHMIESPQQAEDVAKEMLNHNLITKQTGIAGKPVSAVYIVKRVDTKHEAYLSILMDRQTKKPMIIASSQGGMNIEEVAERTPDAIKKFSIETSKGLSPQMAKDVAKSLGFSPDAQDEAAKAVSNLYKIFMERDATQVEINPLSEIEHDPTHKIMCTDAKFGFDDNASFRQEKIYSWRDLSQEDPDEVKAKKYDLNFVKLKGNIGCLVNGAGLAMATMDVIKLNGGDPANFLDCGGGATPETIKQGFELILSNKNVDAIFVNIFGGIVRCDYVALGLVEAARELEVRVPIVARLQGTKVEEGRDIINKSGVKIYSFDELDPAAKKVVELTQN

SEQ ID NO: 170 - protein, 233 aa, Saccharomyces cerevisiae
MFAKTAAANLTKKGGLSLLSTTARRTKVTLPDLKWDFGALEPYISGQINELHYTKHHQTYVNGFNTAVDQFQELSDLLAKEPSPANARKMIAIQQNIKFHGGGFTNHCLFWENLAPESQGGGEPPTGALAKAIDEQFGSLDELIKLTNTKLAGVQGSGWAFIVKNLSNGGKLDVVQTYNQDTVTGPLVPLVAIDAWEHAYYLQYQNKKADYFKAIWNVVNWKEASRRFDAGKI

SEQ ID NO: 171 - protein, 266 aa, Saccharomyces cerevisiae
MFLRSVNRAVTRSILTTPKPAVVKSSWRVFTVANSKRCFTPAAIMRNQETQRVGDILQSELKIEKETLPESTSLDSFNDFLNKYKFSLVETPGKNEAEIVRRTESGETVHVFFDVAQIANLPYNNAMDENTEQNEDGINEDDFDALSDNFANVNVVISKESASEPAVSFELLMNLQEGSFYVDSATPYPSVDAALNQSAEAEITRELVYHGPPFSNLDEELQESLEAYLESRGVNEELASFISAYSEFKENNEYISWLEKMKKFFH

SEQ ID NO: 172 - protein, 224 aa, Saccharomyces cerevisiae
MASTLLTIITSILRCTGFILSKIAKGSRIRELLERCRSSLGVDLHSLLKQLCRDNLKCVALIFMLQLKFIWPVARITPIYRPFTSHPFRNLATSSSISSTKAKTTKTDTTPLKLSNELYAIFKIHNRPYLVTEGDRVILPFKLKQAEVGDILNMTDVTTLGSRNYKLVGHPINTSLYTLKATVVGKTKRAFQTREVTKRRNRRVRHAKSKGDLTILRISELSMN

SEQ ID NO: 173 - protein, 247 aa, Saccharomyces cerevisiae
MLHCARRYMLVRPRLLWQSGTCVARFQSSVRTPASEPSAEKGVDEWLEAINELREEFSAKEYLPETSLAPPGQSKVDLLQGSQAGSKIKPTAEQLAQWEALKSVPIPPRKNATLDHITNMIMRHGKKEKAQTILSRALYLVYCQTRQDPIQALEKSLDELAPLMMTKTFNTGVAKASVIPVPLNKRQRNRIAWNWIVQSANQRVSSDFAVRLGEELTAIAKGTSSAFEKRDQIHKTAIAHRAYIQLK

SEQ ID NO: 174 - protein, 264 aa, Saccharomyces cerevisiae
MFKSVAKLGKSPIFYLNSQRLIHIKTLTTPNENALKFLSTDGEMLFTQTRGSKSIVIKNTDENLINHSKLAQQIFLQCPGVESLMIGDDFLTINKDRMVHWNSIKPFTEIIDLLTKQLAYGEDVISKEFHAVQEEEGEGGYKINMPKFELTEEDEEVSELIEELIDTFTRIRPAILEDGGDIDYRGWDPKTGTVYLRLQGACTSCSSSEVTLKYGIESMLKHYVDEVKFTEVIQIMDPEQEIALKEFDKLEKKLESSKNTSHEK

SEQ ID NO: 175 - protein, 258 aa, Saccharomyces cerevisiae
MINTGRSRNSVLLAHRFLSTGGFWRGGTNGTMSRTINNVDPFKLKFTFIPKTVPAAADSVSPDSQRPGKKPFKFIVSDQSKSSKASKSPKWSSYAFPSRETIKSHEFTEAIKKQNKAIDEQIAAAVSKNDCSCTEPPKKRKRKLRPRKALITLSPKAIKHLRALLAQFTPEPKLIRVSARNRGCSGLTYDLQYETEPGKFDEVVEQDGVKFVIDSKALFSIIGSEMDWFTIDDKLASKFVFKNPNSKGTCGCGESFMV

SEQ ID NO: 176 - protein, 269 aa, Saccharomyces cerevisiae
MKWLLFPARIVARTRPNLFSLYRRSVSQYLRPRTIQNLQSMAQTPELKTKLFKPLVWIDCEMTGLDHVNDRIIEICCIITDGHLAPVKAADGQGDSHYESVIHYGPEVMNKMNEWCIEHHGNSGLTAKVLASEKTLAQVEDELLEYIQRYIPDKNVGVLAGNSVHMDRLFMVREFPKVIDHLFYRIVDVSSIMEVARRHNPALQARNPKKEAAHTAYSDIKESIAQLQWYMDNYLKPPQETESVESIGSEQPESPSSSTSSLKRQRTDF

SEQ ID NO: 177 - protein, 307 aa, Saccharomyces cerevisiae
MLISSRIVRSSLVNVPLRLSRCFTQAHRACKEEEVNSPLSSAAEQPEQKYTHFGSKTVLKSTKQKLVGDVFSSVANRYDLMNDVMSLGIHRLWKDHFINKLDAGKRPNSTTPLNFIDVAGGSGDIAFGLLDHAESKFGDTESTMDIVDINPDMLKEGEKRAMEQGKYFKDPRVRFLVSNGEKLEEIDSDSKDIYTVSFGIRNFTDIQKGLNTAYRVLKPGGIFYCLEFSKIENPLMDFAYQQWAKVLPVMGSMIANDYDSYQYLVESIERFPDQETFKSMIEKAGFKSAGYESLTFGICAIHWGIKV

SEQ ID NO: 178 - protein, 441 aa, Saccharomyces cerevisiae
MRISSTLLQRSKQLIDKYALYVPKTGSFPKGFEVGYTASGVKKNGSLDLGVILNTNKSRPSTAAAVFTTNKFKAAPVLTSKKVLETARGKNINAIVVNSGCANSVTGDLGMKDAQVMIDLVNDKIGQKNSTLVMSTGVIGQRLQMDKISTGINKIFGEEKFGSDFNSWLNVAKSICTTDTFPKLVTSRFKLPSGTEYTLTGMAKGAGMICPNMATLLGFIVTDLPIESKALQKMLTFATTRSFNCISVDGDMSTNDTICMLANGAIDTKEINEDSKDFEQVKLQVTEFAQRLAQLVVRDGEGSTKFVTVNVKNALHFEDAKIIAESISNSMLVKTALYGQDANWGRILCAIGYAKLNDLKSLDVNKINVSFIATDNSEPRELKLVANGVPQLEIDETRASEILALNDLEVSVDLGTGDQAAQFWTCDLSHEYVTINGDYRS

SEQ ID NO: 179 - protein, 183 aa, Saccharomyces cerevisiae
MNSYSLLTRSFHESSKPLFNLASTLLKASKRTQLRNELIKQGPKRPTSAYFLYLQDHRSQFVKENPTLRPAEISKIAGEKWQNLEADIKEKYISERKKLYSEYQKAKKEFDEKLPPKKPAGPFIKYANEVRSQVFAQHPDKSQLDLMKIIGDKWQSLDQSIKDKYIQEYKKAIQEYNARYPLN

SEQ ID NO: 180 - protein, 706 aa, Saccharomyces cerevisiae
MDKLTPSQWKVINKSYEPASTIKVIAGPGSGKTLTLLYKVLHLITVENIKPEEILIFSLTNKAVDSIIENLLSIFENSHTNKEIVHQIGCYTVHGLANRIVVENEGMINIIEEIGWRGLMKLLPPSKRTPHHFRSYKELEKVVKDYKLNNAKNNNPVIEKLVELMDNCKVMTNDDLIIRAKKYLELDSSDSDASSFTQDLRNKYKVVLIDEFQDLYPSLAPLITMICKGKQLIMFGDTNQSIYGFLGSNNEIMSQLDNLHPKNSTTVLKLFDNFRSTPEIISLASKIINRPLAEKQIIDDTDETPSELVRKLPSGVSPQIMTFDDLAAESEFIIDKITQLICSSAKFSDIAILSRTNSHLTAIASILKKYGIPYQKLKSQPDWMDDLRIQFLLDILKVCSLASDEKHNREFNTGDKWQSNFSILVTMSALKGIGDASIQALYKACSLKNLSIWKYLTMVPNFEWPLGLSIKKKMENYTSNLYEMIENDQVHQLDDPMELLEKVASITNNLNLNPTYFQSLSDAQSSLEFKTHLQEMAQVMKVSKSNKPPGISFVKWFLETYFDQTMVFHQSQQALQTTGPGTVKLSTIHSAKGLEFPIVFLTNGSMSNFPMDTNALYVGITRARNLLYMCNMKHERLVSKSSPYSRNIMSNNLFWTYYNKDLKRSVCDVKVTHGYNVQRYNQLRKNFGFYRAYSSLRGCKSVFRRI

SEQ ID NO: 181 - protein, 285 aa, Saccharomyces cerevisiae
MKFLLQQIRNMHVKPIKMRWLTGGVNYSYLLSTEDRRNSWLIDPAEPLEVSPKLSAEEKKSIDAIVNTHHHYDHSGGNLALYSILCQENSGHDIKIIGGSKSSPGVTEVPDNLQQYHLGNLRVTCIRTPCHTKDSICYYIKDLETGEQCIFTGDTLFIAGCGRFFEGTGRDMDMALNQIMLRAVGETNWNKVKIYPGHEYTKGNVSFIRAKIYSDIGQNKEFDALEQYCKSNECTTGHFTLRDELGYNPFMRLDDRAVRLAVGDTAGTYPRSVVMQELRKLKNAM

SEQ ID NO: 182 - protein, 329 aa, Saccharomyces cerevisiae
MLRSTVSKASLKICRHFHRESIPYDKTIKNLLLPKDTKVIFQGFTGKQGTFHASISQEYGTNVVGGTNPKKAGQTHLGQPVFASVKDAIKETGATASAIFVPPPIAAAAIKESIEAEIPLAVCITEGIPQHDMLYIAEMLQTQDKTRLVGPNCPGIINPATKVRIGIQPPKIFQAGKIGIISRSGTLTYEAVQQTTKTDLGQSLVIGMGGDAFPGTDFIDALKLFLEDETTEGIIMLGEIGGKAEIEAAQFLKEYNFSRSKPMPVASFIAGTVAGQMKGVRMGHSGAIVEGSGTDAESKKQALRDVGVAVVESPGYLGQALLDQFAKFK

SEQ ID NO: 183 - protein, 344 aa, Saccharomyces cerevisiae
MTLAELLGRSRIAQVANNHKPLTYTGKKFHPTHQIIETKPSTLYRQEWGLKSAIPSKIKSRYLVYNDLDTLERITTFEPRGGTQWNRLRFQEMGVPIVSNIGRQNPFFKYISRPEDESHAKLSLFKEMKGDTDISPAAMKKRLKKITALIRSFQDEFKEWLVENHPDELKLNSNKLEDYVVKFLNKKLETKTNKKFNTEIIGTGGLSYSLPGKLKNSPNGVIQRTVVPGRILNVVKENNDNKWLAAIGGFVADVVFFQSPPSSFNSMGDFIRMKTFLFEILEASMEKNGSVSMHARLLEPQNDKTREFFNKRPIYKPLTSRRARRPSVGNIQEANNLLNIIKGN

SEQ ID NO: 184 - protein, 165 aa, Saccharomyces cerevisiae [sequence omitted]

SEQ ID NO: 185 - protein, 172 aa, Saccharomyces cerevisiae
MLKIVTRAGHTARISNIAAHLLRTSPSLLTRTTTTTRFLPFSTSSFLNHGHLKKPKPGEELKITFILKDGSQKTYEVCEGETILDIAQGHNLDMEGACGGSCACSTCHVIVDPDYYDALPEPEDDENDMLDLAYGLTETSRLGCQIKMSKDIDGIRVALPQMTRNVNNNDFS

SEQ ID NO: 186 - protein, 488 aa, Saccharomyces cerevisiae
MLRFTNCSCKTFVKSSYKLNIRRMNSSFRTETDAFGEIHVPADKYWGAQTQRSFQNFKIGGARERMPLPLVHAFGVLKKSAAIVNESLGGLDPKISKAIQQAADEVASGKLDDHFPLVVFQTGSGTQSNMNANEVISNRAIEILGGKIGSKQVHPNNHCNQSQSSNDTFPTVMHIAASLQIQNELIPELTNLKNALEAKSKEFDHIVKIGRTHLQDATPLTLGQEFSGYVQQVENGIQRVAHSLKTLSFLAQGGTAVGTGLNTKPGFDVKIAEQISKETGLKFQTAPNKFEALAAHDAIVECSGALNTLACSLFKIAQDIRYLGSGPRCGYHELMLPENEPGSSIMPGKVNPTQNEALTQVCVQVMGNNAAITFAGSQGQFELNVFKPVMIANLLNSIRLITDAAYSFRVHCVEGIKANEPRIHELLTKSLMLVTALNPKIGYDAASKVAKNAHKKGITLKESALELGVLTEKEFDEWVVPEHMLGPK

SEQ ID NO: 187 - protein, 474 aa, Saccharomyces cerevisiae
MEVTSMFLNRMMKTRTGLYRLYSTLKVPHVEINGIKYKTDPQTTNVTDSIIKLTDRSLHLKESHPVGILRDLIEKKLNSVDNTFKIFNNFKPVVTTMENFDSLGFPKDHPGRSKSDTYYINETHLLRTHTSAHELECFQKIRNDSDNIKSGFLISADVYRRDEIDKTHYPVFHQMEGATIWKRTKADVGVKEPMYIEKIREDIRQVENLLNKENVKITVDDDTIPLKENNPKQEYMSDLEVDLCSQHLKRSIELIVSEVFNKKISSMIKNKANNTPKELKVRWINAYFPWTAPSWEIEVWWQGEWLELCGCGLIRQDVLLRAGYKPSETIGWAFGLGLDRIAMLLFEIPDIRLLWSRDERFSRQFSKGLITSFKPYSKHPGSFRDVAFWLPEDKPDIHQVHENDLMEIIRNIAGDLVESVKLVDSFTHPKTGRKSMCYRINYQSMDRNLTNAEVNTLQDMVCSKLVKEYSVELR

SEQ ID NO: 188 - protein, 185 aa, Saccharomyces cerevisiae
MQAKLLFTRLNFRRPSTTLRQFPLTCFLFHSKAFYSDLVTKEPLITPKRIINKTPGLNLSISERASNRLAEIYRNSKENLRISVESGGCHGFQYNLTLEPATKPDIKNDVKDKEFSDDLDDDDSKDIIYVLPEDKGRVIIDSKSLNILNNTTLTYTNELIGSSFKIINGSLKSSCGCGSSFDIEN

SEQ ID NO: 189 - DNA, 750 bp, Glycine max
ataattttgattttattgaattttttttttatttttgccaattctatttattctttctaataatcaaaaatattctaataactaataataaaaaggaaaataaagattcattagaatattataaaataacaaataatagaacaaaacaagattctttagttatatatgtaaaacaaaaatggtttatttataagaatacatattccattctatatcaaaacaaaatataaaaatttggaatagattctatgaaatctcaaaaaatcccgctattcaattattcattaaacatatgaatattagtgcatattattttatcgattagattaaatagattatctatatatatagatagatatctatttgaattgcttcattcgcgaggagccgtatgaggtgaaaatctcatgtacggttctgtaataaagatggaattgagaaacaaccatcaattataacccccaaagaaccagatttcgtaaacaacatagaggaagaatgaaaggaatatcctatcgagggaatcatatttgcttcggaagatatgctcttcaagcacttgagccagcttggataacatctagacaaatagaagcgggacggcgggcaatgtcacgaaatgttcgccgaggtggacaaatatgggtacgcatatttccagacaaaccggttacagtaagacctactgaaacacgtatgggttcaggaaaaggttctcccgaatattgggtagctgtcgttaaacctggg

SEQ ID NO: 190 - protein, 552 aa, Pisum sativum
MNQAMATPLSLSCCSPTLTRSTLFFTKTFPFSRSFSTPLPLSTKTLISLSPPHRTFAVRAESQNGADPARQYDFDLFTIGAGSGGVRASRFASNFGASSAVCELPFSTISSDTTGGVGGTCVIRGCVPKKLLVYASKFSHEFEESNGFGWRYDSEPKHDWSSLIANKNAELQRLTGIYKNTLKNAGVKLIEGRGKIVDAHTVDVDGKLYSAKHILVSVGGRPFIPDIPGKEYAIDSDAALDLPSKPQKIAIVGGGYIALEFAGIFNGLKSEVHVFIRQKKVLRGFDEEIRDFVAENMALRGIEFHTEESPVAITKAADGSLSLKTNKGTEEGFSHIMFATGRSPNTKDLGLESVGVKVAKDGSIEVDEYSQTSVPSIWAIGDATNRVNLTPVALMEGVALAKTLFQNEPTKPDYRAIPSAVFSQPPIGGVGLTEEQAAEQYGDIDVFTANFRPMKATLSGLPDRVFMKLIVSAETNVVLGLHMCGEDAAEIAQGFAVGIKAGLTKADFDATVGIHPTAAEEFVTMRTPTRKVRKNQASQGKSDSKAKAVAGS

SEQ ID NO: 191 - protein, 735 aa, Chlamydomonas reinhardtii
MAATYSLATSPLTRSTPIPFSTKRVPSGRSSGALPVPGSQARLSGAGAVALDGLEGGRDDWHQRYSLSTSGRRRSVASGAPSNTGSSEAKNVVMASWNVTVGFSVGASSSAFSDASSFSFPARSAPAGPVARPPRTGVSLLSRALSTGEKEQDLLAHLPPVLPSTDAADPLLFFPGIPLELLREAQAEFPIFNNELLVHAYGLAARAHQNQQRKNGESLLSHCVAVAKTVAGLGLDAETVAAALLHECVDMVSRSQLEEFMPPSVVSVLEHVNTISEMSRLYRQHSATGSFSDETFQRLLVGFEDVKAVIVKLSDRLAELRTISVLPADRQAALARETLEVYSVVADRLGVWCLKAELEDLAFSVLHPQEYNWLKEAVRTRQDPVALETAINSIKGALQAQGVAYEDISGRPKNLYGIFMKLQKDGKPLTIESLNSLYDLMALRVVVAHKHECYTALRAVQSVYRVMPSRSKDFIKDIKKPNGYQSLHETVYGEGDVPVEVQIRTHKMHYIAEYGFAAHWKYKEQMDSEDEWLEKETQYKRWLTQYKLRVHDKKVRPQGSPPTDSSLKSLGVAYMDMPEEQQRGLLDPFLQHERFKLQVPAKTEVSVLLQTCDGIETKDFPLGTTANQLWRDLGLGAQPGYALTVNSRLPSGEAALQSGDLVQVLPLSTILSRSPPQSAPLAAVLEDWEEEQAHAAAEAAALAASANNYLEVYSRDGMTTWSMGPNAGAAVPAGM

SEQ ID NO: 192 - protein, 260 aa, Pisum sativum
MAAAHTPREENVYMAKLAEQAERYEEMVEFMEKVSANADSEELTVEERNLLSVAYKNVIGARRASWRIISSIEQKEESRGNEDHVDVIRDVRSKIESELSNICDGILKLLDTRLIPSASSGDSKVFYLKMKGDYHRYLAEFKTGAERKEAAESTLAAYKSAQDIANAELPPTHPIRLGLALNFSVFYYEILNSPDRACNLAKQAFDEAIAELDTLGEESYKDSTLIMQLLRDNLTLWTSDMQDDGADEIKEHAPKADEQQ

SEQ ID NO: 193 - protein, 564 aa, Arabidopsis thaliana
MEALQFSSVNRVPCTLSCTGNRRIKAAFSSAFTGGTINSASLSSSRNLSTREIWSWVKSKTVVGHGRYRRSQVRAVMFGQLTGGLEAAWSKLKGEEVLTKDNIAEPMRDIRRALLEADVSLPVVRRFVQSVSDQAVGMGVIRGVKPDQQLVKIVHDELVKLMGGEVSELQFAKSGPTVILLAGLQGVGKTTVCAKLACYLKKQGKSCMLIAGDVYRPAAIDQLVILGEQVGVPVYTAGTDVKPADIAKQGLKEAKKNNVDVVIMDTAGRLQIDKGMMDELKDVKKFLNPTEVLLVVDAMTGQEAAALVTTFNVEIGITGAILTKLDGDSRGGAALSVKEVSGKPIKLVGRGERMEDLEPFYPDRMAGRILGMGDVLSFVEKATEVMRQEDAEDLQKKIMSAKFDFNDFLKQTRAVAKMGSMTRVLGMIPGMGKVSPAQIREAEKNLLVMEAMIEVMTPEERERPELLAESPERRKRIAKDSGKTEQQVSALVAQIFQMRVKMKNLMGVMEGGSIPALSGLEDALKAEQKAPPGTARRKRKADSRKKFVESASSKPGPRGFGSGN

SEQ ID NO: 194 - protein, 525 aa, PISUM SATIVUM
  MISC_FEATURE (181)..(181): Xaa can be any naturally occurring amino acid
EFGTRNSFAREIWGLVQSKSLTSRRTDMIRPVVVRAEMFGQLTSGLESAWNKLKREEVLTKENIVEPMRDIRRARADVSLPVVRRFVQSVTDKAVGVGVTRGVKPDQQLVKIVHDELVQLMGGEVSELTFANSGPTVILLAGLQGVGKTTVCAKLATYFKKQGKSCMLVAGDVYRPAAIDXLTILGKQVDVPVYAAGTDVKPSVIAKQGFEEAKKKKIDVVIVDTAGSLQIDKAMMDELKEVKQVLNPTEVLLVVDAMTGQEAAALVTTFNLEIGITGAILTKLDGDSRGGAALSVKEVSGKPIKLVGRGERMEDLEPFYPDRMAGRILGMGDVLSFVEKAQEVMLEEDAEDMQKKIMSAKFDFNDLLKQTRTVAKMGSVSRVLGMIPGMAKVTPAQIREAEKNLQFMEVIIEAMTPEERGKPELLAEFPVRRKSVAQESGKTEQQVSQLVAQLFQMRVRMKKLMGVMEGGSMPTLSNLEEALKANKKAPPGTARRKKKGGLKRLFKGRSSKISLPAPRGFGSKN

SEQ ID NO: 195 - protein, 376 aa, Arabidopsis thaliana
MQKVFLAMDTCALVIHQSLSRIKLSPPKSSSSSSSSSSAFSPESLPIRRIELCFRGAICAAVQRNYEETTSSVEEAEEDDESSSSYGEVNKIIGSRTAGEGAMEYLIEWKDGHSPSWVPSSYIAADVVSEYETPWWTAAKKADEQALSQLLEDRDVDAVDENGRTALLFVAGLGSDKCVRLLAEAGADLDHRDMRGGLTALHMAAGYVRPEVVEALVELGADIEVEDERGLTALELAREILKTTPKGNPMQFGRRIGLEKVINVLEGQVFEYAEVDEIVEKRGKGKDVEYLVRWKDGGDCEWVKGVHVAEDVAKDYEDGLEYAVAESVIGKRVGDDGKTIEYLVKWTDMSDATWEPQDNVDSTLVLLYQQQQPMNE

SEQ ID NO: 196 - protein, 364 aa, Spinacia oleracea
MACSLSFSSSVSTFHLPTTTQSTQAPPNNATTLPTTNPIQCANLRELRDRIGSVKNTQKITEAMKLVAAAKVRRAQEAVVNGRPFSETLVEVLYNMNEQLQTEDVDVPLTKIRTVKKVALMVVTGDRGLCGGFNNMLLKKAESRIAELKKLGVDYTIISIGKKGNTYFIRRPEIPVDRYFDGTNLPTAKEAQAIADDVFSLFVSEEVDKVEMLYTKFVSLVKSDPVIHTLLPLSPKGEICDINGKCVDAAEDELFRLTTKEGKLTVERDMIKTETPAFSPILEFEQDPAQILDALLPLYLNSQILRALQESLASELAARMTAMSNATDNANELKKTLSINYNRARQAKITGEILEIVAGANACV

SEQ ID NO: 197 - protein, 147 aa, Spinacia oleracea
MAATTTTMMGMATTFVPKPQAPPMMAALPSNTGRSLFGLKTGSRGGRMTMAAYKVTLVTPTGNVEFQCPDDVYILDAAEEEGIDLPYSCRAGSCSSCAGKLKTGSLNQDDQSFLDDDQIDEGWVLTCAAYPVSDVTIETHKEEELTA

SEQ ID NO: 198 - protein, 147 aa, Spinacia oleracea; identical to SEQ ID NO: 197

SEQ ID NO: 199 - protein, 364 aa, Spinacia oleracea; identical to SEQ ID NO: 196

SEQ ID NO: 200 - protein, 179 aa, Oryza sativa (japonica cultivar-group)
MAMASTAVSSTLPLFHVRTASSAPAALRFTTRGRGGGRHSVACNSTAASSPKVLELGDAIAGLTLEEARGLVDHLQERLGVSAAAFAPAAVVAAPGAAGGGEDGAPAEKTEFDVVIEEVPSSARIATIKVVRALTNLALKEAKDLIEGLPKKAKEAVSKEEAEEAKKQLEEVGAKVSIA

SEQ ID NO: 201 - protein, 185 aa, Oryza sativa (japonica cultivar-group)
MASTALSSAFSLLSLPSSSSPAAAAAAAPRSFAVPSRARPRRAVAVVASTATESPKVLELGDAIAGLTLEEARGLVDHLQERLGVSAAAFAPAAVVAAPGAGGAGAAADEAPAEKTEFDVVIEEVPSSARIASIKVVRALTNLALKEAKDLIEGLPKKVKEGVSKDEAEDAKKQLEEVGAKVSIA

SEQ ID NO: 202 - protein, 1259 aa, Pisum sativum
MPMAASTSTSSLSVVGTNLSLPPHRHHRHFHSPSSISTRIRTNRLFLSSSLAFSSPRDARVVHAGLGLRRNTPDVWKHYSSVLSQPTAPVPVRQSCTSCCLASAKKRRSNLPRFVPGAFFDSSSFGLSKDKLRHASVKRVQLPHATVGPDEPHAASTTWQEGVAEKQDLSLFDSELERLEGFLGSELPSHPKLHRGQLKNGIRYLILPNKVPPTRFEAHMEVHVGSIDEEDDEQGIAHMIEHVAFLGSKKREKLLGTGARSNAYTDFHHTVFHIHSPTSTKDSDDLLPSVLDALNEITFHPNFLASRIEKERRAILSELQMMNTIEYRVDCQLLQHLHSENKLSKRFPIGLEEQIKKWDADKIRKFHERWYFPANATLYIVGDIGNIPKTVNQIEAVFGQTGVDNEKGSVATSSAFGAMASFLVPKLSVGLGGNSIERPTNTTDQSKVFKKERHAVRPPVKHTWSLPGSSANLKPPQIFQHELLQNFSINMFCKIPVNKVQTYRDLRIVLMKRIFLSALHFRINTRYKSSNPPFTSVELDHSDSGREGCTVTTLTITAEPKNWQNAIRVAVHEVRRLKEFGVTQGELTRYLDALLRDSEHLAAMIDNVSSVDNLDFIMESDALGHKVMDQSQGHESLIAVAGTVTLDEVNSVGAQVLEFIADFGKLSAPLPAAIVACVPKKVHIEGAGETEFKISSTEITDAMKAGLDEPIEPEPELEVPKELVQSSTLQELKNQRKPAFIPVSPEIEAKKLHDEETGITRLRLANGIPVNYKISKSETQSGVMRLIVGGGRAAEGSDSRGSVIVGVRTLSEGGRVGNFSREQVELFCVNNQINCSLESTEEFISLEFRFTLRNNGMRAAFQLLHMVLEHSVWSDDALDRARQVYLSYYRSIPKSLERSTAHKLMVAMLDGDERFTEPTPSSLENLTLQSVKDAVMNQFVGNNMEVSIVGDFTEEEIESCILDYLGTAQATGNFKNQQQIIPPTFRLSPSSLQSQEVFLNDTDERACAYIAGPAPNRWGFTADGNDLLETIDNASSVNNNGTKSDALQTEGAPRRSLRSHPLFFGITMGLLSEIINSRLFTTVRDSLGLTYDVSFELNLFDRLKLGWYVVSVTSTPSKVHKAVDACKNVLRGLHSNGITVRELDRAKRTLLMRHEAEIKSNAYWLGLLAHLQSSSVPRKDLSCIKDLTSLYEAATIEDTCLAYEQLKVDEDSLYSCIGVSGAQAAQDIAAPVEEEEAGEGYPGVLPMGRGLSTMTRPTT

SEQ ID NO: 203 - protein, 332 aa, Arabidopsis thaliana
MAASLQSTATFLQSAKIATAPSRGSSHLRSTQAVGKSFGLETSSARLTCSFQSDFKDFTGKCSDAVKIAGFALATSALVVSGASAEGAPKRLTYDEIQSKTYMEVKGTGTANHSPTIDGGSETFSFKPGKYAGKKFCFEPTSFTVKADSVSKNAPPEFQNTKLMTRLTYTLDEIEGPFEVASDGSVNFKEEDGIDYAAVTVQLPGGERVPFLFTVKQLDASGKPDSFTGKFLVPSYRGSSFLDPKGRGGSTGYDNAVALPAGGRGDEEELVKENVKNTAASVGEITLKVTKSKPETGEVIGVFESLQPSDTDLGAKVPKDVKIQGVWYGQLE

SEQ ID NO: 204 - DNA, 255 bp, Oryza sativa
gagcagtcggtgtcccccggcggcggcgcgtggctcggcgggcagctgttctccgccatggtggtgcgcaagccggcgcacctgttcctcgacgagctcggcgtcgcgtacgacgagcaggaggactacgtcgtcatcaagcacgccgcgctcttcacctccaccgtcatgagccgcctcctggcgcgccccaacgtgaagctgttcaacgccgtcgccgtcgaggacctcatcgtcaaggagggccgcgtcggc

SEQ ID NO: 205 - DNA, 606 bp, oryza sativa (japonica cultivar-group)
  misc_feature (349)..(349): n is a, c, g, or t
cagagcaagaagctcagctcctcctcctctcgcatggcagccatggccaccaccgcgtccagcctcctcaagacctccttcgccggcgtgcgcctccccgccgccgcccgcaaccccaccgtctccgtcgcgccgcgcaccggcggcgccatctgcaactccatctcgtcgtcgtcgtccactcccccctacgacctcaacgccatcaggttcagccccatcaaggagtccatcgtgtcccgcgagatgacccggcggtacatgaccgacatgatcacctacgccgacaccgacgtcgtcgtcgtcggcgccggctccgcggggctctcctgcgcgtacgagctctccnaggacccctccgtcagcgtcgccgtcatcgagcagtcggtgtcccccggcggcggcgcgtggctcggcgggcagctgttctccgccatggtggtgcgcaagccggcgcacctgttcctcgacgagctcggcgtcgcgtacgacgagcaggaggactacgtcgtcatcaagcacgccgcgctcttcacctccaccgtcatgagccgcctcctggcgcgccccacgtgaaactgttcaacgccgtcgccgtcgaggacc

SEQ ID NO: 206 - DNA, 741 bp, TFAM Sequence
atggcgtttctccgaagcatgtggggcgtgctgagtgccctgggaaggtctggagcagagctgtgcaccggctgtggaagtcgactgcgctcccccttcagttttgtgtatttaccgaggtggttttcatctgtcttggcaagttgtccaaagaaacctgtaagttcttaccttcgattttctaaagaacaactacccatatttaaagctcagaacccagatgcaaaaactacagaactaattagaagaattgcccagcgttggagggaacttcctgattcaaagaaaaaaatatatcaagatgcttatagggcggagtggcaggtatataaagaagagataagcagatttaaagaacagctaactccaagtcagattatgtctttggaaaaagaaatcatggacaaacatttaaaaaggaaagctatgacaaaaaaaaaagagttaacactgcttggaaaaccaaaaagacctcgttcagcttataacgtttatgtagctgaaagattccaagaagctaagggtgattcaccgcaggaaaagctgaagactgtaaaggaaaactggaaaaatctgtctgactctgaaaaggaattatatattcagcatgctaaagaggacgaaactcgttatcataatgaaatgaagtcttgggaagaacaaatgattgaagttggacgaaaggatcttctacgtcgcacaataaagaaacaacgaaaatatggtgctgaggagtgttaa

SEQ ID NO: 207 - protein, 16 aa, artificial sequence
  transportan
RQIKIWFQNRRMKWKK

SEQ ID NO: 208 - protein, 291 aa, artificial sequence
  synthetic sequence
MRRRRRRRRRRRGEGDIMGEWGNEIFGAIAGFLGGEMAATQLTASPVTMSARSLASLDGLRASSVKFSSLKPGTLRQSQFRRLVVKASSVLASCPKKPVSSYLRFSKEQLPIFKAQNPDAKTTELIRRIAQRWRELPDSKKKIYQDAYRAEWQVYKEEISRFKEQLTPSQIMSLEKEIMDKHLKRKAMTKKKELTLLGKPKRPRSAYNVYVAERFQEAKGDSPQEKLKTVKENWKNLSDSEKELYIQHAKEDETRYHNEMKSWEEQMIEVGRKDLLRRTIKKQRKYGAEEC

SEQ ID NO: 209 - protein, 262 aa, artificial sequence
  synthetic sequence
MRRRRRRRRRRRGEGDIMGEWGNEIFGAIAGFLGGEMFRSMLVRSSASAKQAVIRRSFSSVLASCPKKPVSSYLRFSKEQLPIFKAQNPDAKTTELIRRIAQRWRELPDSKKKIYQDAYRAEWQVYKEEISRFKEQLTPSQIMSLEKEIMDKHLKRKAMTKKKELTLLGKPKRPRSAYNVYVAERFQEAKGDSPQEKLKTVKENWKNLSDSEKELYIQHAKEDETRYHNEMKSWEEQMIEVGRKDLLRRTIKKQRKYGAEEC

SEQ ID NO: 210 - protein, 271 aa, artificial sequence
  synthetic sequence
MRRRRRRRRRRRGEGDIMGEWGNEIFGAIAGFLGGEMPTEERVRKRKESNRESARRSRYRKAAHLKCSSVLASCPKKPVSSYLRFSKEQLPIFKAQNPDAKTTELIRRIAQRWRELPDSKKKIYQDAYRAEWQVYKEEISRFKEQLTPSQIMSLEKEIMDKHLKRKAMTKKKELTLLGKPKRPRSAYNVYVAERFQEAKGDSPQEKLKTVKENWKNLSDSEKELYIQHAKEDETRYHNEMKSWEEQMIEVGRKDLLRRTIKKQRKYGAEEC

SEQ ID NO: 211 - protein, 227 aa, PTD-NLS-TFAM Peptide
MARRRRRRRRRRRPKKKRKVEDPSSVLASCPKKPVSSYLRFSKEQLPIFKAQNPDAKTTELIRRIAQRWRELPDSKKKIYQDAYRAEWQVYKEEISRFKEQLTPSQIMSLEKEIMDKHLKRKAMTKKKELTLLGKPKRPRSAYNVYVAERFQEAKGDSPQEKLKTVKENWKNLSDSEKELYIQHAKEDETRYHNEMKSWEEQMIEVGRKDLLRRTIKKQRKYGAEEC

SEQ ID NO: 212 - protein, 246 aa, Homo sapiens
MAPLASMTGVLSALGASGAGLCTGCGSALASPPSPVTLPATPSSVLASCPLLPVSSTLAPSLGGLPIPLAGAPAALTTGLIAAIAGATAGLPASLLLITGAATAAGTGVTLGGISAPLGGLTPSGIMSLGLGIMALHLLALAMTLLLGLTLLGLPLAPASATAVTVAGAPGGALGASPGGLLLTVLGATLALSASEKELYIGHALGAGTATHAGMLSTGGGMIGVGALALLAATILLGALTGAGGC

SEQ ID NO: 213 - protein, 243 aa, Mus musculus
MALFRGMWSVLKALGRTGVEMCAGCGGRIPSSISLVCIPKCFSSMGSYPKKPMSSYLRFSTEQLPKFKAKHPDAKLSELVRKIAALWRELPEAEKKVYEADFKAEWKAYKEAVSKYKEQLTPSQLMGMEKEARQRRLKKKALVKRRELILLGKPKRPRSAYNIYVSESFQEAKDDSAQGKLKLVNEAWKNLSPEEKQAYIQLAKDDRIRYDNEMKSWEEQMAEVGRSDLIRRSVKRSGDISEH

SEQ ID NO: 214 - protein, 244 aa, Rattus norvegicus
MALFRGMWGVLRTLGRTGVEMCAGCGGRIPSPVSLICIPKCFSSLGNYPKKPMSSYLRFSTEQLPKFKAKHPDAKVSELIRKIAAMWRELPEAEKKVYEADFKAEWKVYKEAVSKYKEQLTPSQLMGLEKEARQKRLKKKAQIKRRELILLGKPKRPRSAYNIYVSESFQGAKDESPQGKLKLVNQAWKNLSHDEKQAYIQLAKDDRIRYDNEMKSWEEQMAEVGRSDLIRRSVKRPPGDISEN

SEQ ID NO: 215 - protein, 446 aa, Arabidopsis thaliana
MSTVSSDPAHAKKSRNSRKALKQKNEIVESSPVSDKGKETKSFEKDLMEMQAMLEKMKIEKEKTEDLLKEKDEILRKKEVEQEKLKTELKKLQKMKEFKPNMTFAFSQSLAQTEEEKKGKKKKKDCAETKRPSTPYILWCKDNWNEVKKQNPEADFKETSNILGAKWKGISAEEKKPYEEKYQADKEAYLQVITKEKREREAMKLLDDEQKQKTAMELLDQYLHFVQEAEHDNKKKAKKIKDPLKPKQPISAYLIYANERRAALKGENKSVIEVAKMAGEEWKNLSEEKKAPYDQMAKKNKEIYLQEMEGYKRTKEEEAMSQKKEEEEFMKLHKQEALQLLKKKEKTDNIIKKTKETAKNKKKNENVDPNKPKKPTSSYFLFCKDARKSVLEEHPGINNSTVTAHISLKWMELGEEEKQVYNSKAAELMEAYKKEVEEYNKTKTSS

SEQ ID NO: 216 - protein, 204 aa, Caenorhabditis elegans
MLGTISMRFFATKVVAPRASVAASTPQVPLGMNINPYAMFIKENFKANTSDMKRTDLMKELSGKWKALSISEKDKYTELSKNYNAQKLDDFMKLSTEEQKKLVDSAKEKKAERASRRHAKERREKRKQSGRPSVPPSAYALFIKEKLSGAGMESKEKMKEAVAQWKAFTDSQKKKYTDEAKKLKDEYHVVLQKWEAEQKENADQ

SEQ ID NO: 217 - protein, 257 aa, Drosophila melanogaster
MIYTTTLMSSRGGLIGSLINKVRPLAAASISNTPAVPSKTLEEQLGLPPRPKKPLTPYFRFMREQRPKLKAANPQITTVEVVRQLSKNWSDADAQLKERLQAEFKRDQQIYVEERTKYDATLTEEQRAEIKQLKQDLVDAKERRQLRKRVKELGRPKKPASAFLRFIASERINTPQGDKQTYREWHQKTTAKWTRLSDSEKEVYMQESRKEMELYRKAISVWEEKMIRLGHIDVVRHGNLIDPPEPKPRKTLASKDI

SEQ ID NO: 218 - protein, 259 aa, artificial sequence
  PTD-MLS-TFAM
MARRRRRRRRRRRMAFLRSMWGVLSALGRSGAELCTGCGSRLRSPFSFVYLPRWFSSVLASCPKKPVSSYLRFSKEQLPIFKAQNPDAKTTELIRRIAQRWRELPDSKKKIYQDAYRAEWQVYKEEISRFKEQLTPSQIMSLEKEIMDKHLKRKAMTKKKELTLLGKPKRPRSAYNVYVAERFQEAKGDSPQEKLKTVKENWKNLSDSEKELYIQHAKEDETRYHNEMKSWEEQMIEVGRKDLLRRTIKKQRKYGAEEC

What is claimed is:

1. A method for transfecting a plant the method comprising contacting one or more cells of the plant with a polynucleotide packaged with a polynucleotide-packaging polypeptide, wherein the polynucleotide-packaging polypeptide comprises SEQ ID NO: 209.

2. A method for transfecting a plant the method comprising contacting one or more cells of the plant with a polynucleotide packaged with a polynucleotide-packaging polypeptide, wherein the polynucleotide-packaging polypeptide comprises SEQ ID NO:210.

3. A method for transfecting a plant cell comprising contacting the plant cell with a polynucleotide packaged with a fusion protein comprising a protein transduction domain fused to an organelle localization signal fused to mature mitochondrial transcription factor A (TFAM).

4. The method of claim 3 wherein the TFAM is human TFAM.

5. The method of claim 3 wherein the protein transduction domain comprises 8-15 positively charged amino acids.

6. The method of claim 3 wherein the protein transduction domain comprises 11 arginine residues.

7. The method of claim 3 wherein the organelle localization signal is selected from the group consisting of a nuclear localization signal, a mitochondrial localization signal, and a chloroplast localization signal.

* * * * *

UNITED STATES PATENT AND TRADEMARK OFFICE
CERTIFICATE OF CORRECTION

PATENT NO. : 8,062,891 B2  
APPLICATION NO. : 11/930892  
DATED : November 22, 2011  
INVENTOR(S) : Shaharyar Khan Page 1 of 1

It is certified that error appears in the above-identified patent and that said Letters Patent is hereby corrected as shown below:

Specification, column 1, lines 18-20, replace "Aspects of the following disclosure were supported in part by NIH-NIA SBIR grant number AG022780. Therefore, the United States has certain rights in the disclosure." with --This invention was made with government support under Grant Number AG022780, awarded by the National Institutes of Health-National Institute on Aging Small Business Innovation Research (NIH-NIA SBIR). The government has certain rights in the invention--.

Signed and Sealed this  
Sixth Day of November, 2012

David J. Kappos  
*Director of the United States Patent and Trademark Office*